United States Patent 7,745,391 (HUMAN THROMBOSPONDIN POLYPEPTIDE) - sequence listing, part 275

SEQ ID NO: 827197 - protein, 2114 aa, Homo sapiens
RGTKGKKVRPESLKNQCTPEPSGDMNPLEGKQDSHVGTVHAQLQRQQATDYSQEQQGKLLSPRSLGSTDSGYFSRSESADQTVSPPTPFARRFPAQNKTLEGVTDPLQLLSPRQHPLLCHREKALLLPGQMRPPLATKTLEERISKLISDNEALVDDKQLDSVKPRRTSLSRRGSIDSPKSYIFKDSFQFDLKPVGRRTSSSSDIPKSPFTPTEKSKQVFLLSVPSLDCLPITRSNSMPTTGYSAVPANIIPPPHPLRGSQSFDDKIGAFYDDVFVSGPNAPVPQSGHPRTLVRQAAIEDSSANESHVLGTGQSLDESHQGCHAAGEAMSVRSKALAQGPHIEKKKSHQGRGTMFECETCRNRYRKLENFENHKKFYCSELHGPKTKVAMREPEHSPVPGGLQPQILHYRVAGSSGIWEQTPQIRKRRKMKSVGDDEELQQNESGTSPKSSEGLQFQNALGCNPSLPKHNVTIRSDQQHKNIQLQNSHIHLVARGPEQTMDPKLSTIMEQQISSAAQDKIELQRHGTGISVIQHTNSLSRPNSFDKPEPFERASPVSFQELNRTGKSGSLKVIGISQEESHPSRDGSHPHQLALSDALRGELQESSRKSPSERHVLGQPSRLVRQHNIQVPEILVTEEPDRDLEAQCHDQEKSEKFSWPQRSETLSKLPTEKLPPKKKRLRLAEIEHSSTESSFDSTLSRSLSRESSLSHTSSFSASLDIEDVSKTEASPKIDFLNKAEFLMIPAGLNTLNVPGCHREMRRTASEQINCTQTSMEVSDLRSKSFDCGSITPPQTTPLTELQPPSSPSRVGVTGHVPLLERRRGPLVRQISLNIAPDSHLSPVHPTSFQNTALPSVNAVPYQGPQLTSTSLAEFSANTLHSQTQVKDLQAETSNSSSTNVFPVQQLCDINLLNQIHAPPSHQSTQLSLQVSTQGSKPDKNSVLSGSSKSEDCFAPKYQLHCQVFTSGPSCSSNPVHSLPNQVISDPVGTDHCVTSATLPTKLIDSMSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 827198 - protein, 645 aa, Homo sapiens
MLSWVPWRRVTGLHGVALPHGLDKIEEAQKELNGAEVSKKEILQAGVKGTSESLKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 827199 - protein, 2598 aa, Homo sapiens
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSELRRWRSEGADPAKFSDLDEQCDSSSLSSKTRTDNSECISSHCGTTSPSYTNTAFDVLLKAMEPELSTLSQKGSPCAIKTEKLRPNKTARSPPKLKNSSMDAPNQTSQELVAESQSSCTSYTVHMSAAQKNEQGAMQSASHLYHQHEHFVPKSNQHNQQLPGCSGFTGSLTNLQNQENAKLEQVYNIAVTSSVGLTSPSSRSQVTPQNQQMDSASPLSISPANSTQSPPMPIYNSTHVASVVNQSVEQMCNLLLKDQKPKKQGKYICEYCNRACAKPSVLLKHIRSHTGERPYPCVTCGFSFKTKSNLYKHKKSHAHTIKLGLVLQPDAGGLFLSHESPKALSIHSDVEDSGESEEEGATDERQHDLGAMELQPVHIIKRMSNAETLLKSSFTPSSPENVIGDFLLQDRSAESQAVTELPKVVVHHVTVSPLRTDSPKAMDPKPELSSAQKQKDLQVTNVQPLSANMSQGGVSRLETNENSHQKGDMNPLEGKQDSHVGTVHAQLQRQQATDYSQEQQGKLLSPRSLGSTDSGYFSRSESADQTVSPPTPFARRFPAQNKTLEGVTDPLQLLSPRQHPLLCHREKALLLPGQMRPPLATKTLEERISKLISDNEALVDDKQLDSVKPRRTSLSRRGSIDSPKSYIFKDSFQFDLKPVGRRTSSSSDIPKSPFTPTEKSKQVFLLSVPSLDCLPITRSNSMPTTGYSAVPANIIPPPHPLRGSQSFDDKIGAFYDDVFVSGPNAPVPQSGHPRTLVRQAAIEDSSANESHVLGTGQSLDESHQGCHAAGEAMSVRSKALAQGPHIEKKKSHQGRGTMFECETCRNRYRKLENFENHKKFYCSELHGPKTKVAMREPEHSPVPGGLQPQILHYRVAGSSGIWEQTPQIRKRRKMKSVGDDEELQQNESGTSPKSSEGLQFQNALGCNPSLPKHNVTIRSDQQHKNIQLQNSHIHLVARGPEQTMDPKLSTIMEQQISSAAQDKIELQRHGTGISVIQHTNSLSRPNSFDKPEPFERASPVSFQELNRTGKSGSLKVIGISQEESHPSRDGSHPHQLALSDALRGELQESSRKSPSERHVLGQPSRLVRQHNIQVPEILVTEEPDRDLEAQCHDQEKSEKFSWPQRSETLSKLPTEKLPPKKKRLRLAEIEHSSTESSFDSTLSRSLSRESSLSHTSSFSASLDIEDVSKTEASPKIDFLNKAEFLMIPAGLNTLNVPGCHREMRRTASEQINCTQTSMEVSDLRSKSFDCGSITPPQTTPLTELQPPSSPSRVGVTGHVPLLERRRGPLVRQISLNIAPDSHLSPVHPTSFQNTALPSVNAVPYQGPQLTSTSLAEFSANTLHSQTQVKDLQAETSNSSSTNVFPVQQLCDINLLNQIHAPPSHQSTQLSLQVSTQGSKPDKNSVLSGSSKSEDCFAPKYQLHCQVFTSGPSCSSNPVHSLPNQVISDPVGTDHCVTSATLPTKLIDSMSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANLSNKSND

SEQ ID NO: 827200 - protein, 2293 aa, Homo sapiens
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSELRRWRSEGADPAKFSDLDEQCDSSSLSSKTRTDNSECISSHCGTTSPSYTNTAFDVLLKAMEPELSTLSQKGSPCAIKTEKLRPNKTARSPPKLKNSSMDAPNQTSQELVAESQSSCTSYTVHMSAAQKNEQGAMQSASHLYHQHEHFVPKSNQHNQQLPGCSGFTGSLTNLQNQENAKLEQVYNIAVTSSVGLTSPSSRSQVTPQNQQMDSASPLSISPANSTQSPPMPIYNSTHVASVVNQSVEQMCNLLLKDQKPKKQGKYICEYCNRACAKPSVLLKHIRSHTGERPYPCVTCGFSFKTKSNLYKHKKSHAHTIKLGLVLQPDAGGLFLSHESPKALSIHSDVEDSGESEEEGATDERQHDLGAMELQPVHIIKRMSNAETLLKSSFTPSSPENVIGDFLLQDRSAESQAVTELPKVVVHHVTVSPLRTDSPKAMDPKPELSSAQKQKDLQVTNVQPLSANMSQGGVSRLETNENSHQKGDMNPLEGKQDSHVGTVHAQLQRQQATDYSQEQQGKLLSPRSLGSTDSGYFSRSESADQTVSPPTPFARRFPAQNKTLEGVTDPLQLLSPRQHPLLCHREKALLLPGQMRPPLATKTLEERISKLISDNEALVDDKQLDSVKPRRTSLSRRGSIDSPKSYIFKDSFQFDLKPVGRRTSSSSDIPKSPFTPTEKSKQVFLLSVPSLDCLPITRSNSMPTTGYSAVPANIIPPPHPLRGSQSFDDKIGAFYDDVFVSGPNAPVPQSGHPRTLVRQAAIEDSSANESHVLGTGQSLDESHQGCHAAGEAMSVRSKALAQGPHIEKKKSHQGRGTMFECETCRNRYRKLENFENHKKFYCSELHGPKTKVAMREPEHSPVPGGLQPQILHYRVAGSSGIWEQTPQIRKRRKMKSVGDDEELQQNESGTSPKSSEGLQFQNALGCNPSLPKHNVTIRSDQQHKNIQLQNSHIHLVARGPEQTMDPKLSTIMEQQISSAAQDKIELQRHGTGISVIQHTNSLSRPNSFDKPEPFERASPVSFQELNRTGKSGSLKVIGISQEESHPSRDGSHPHQLALSDALRGELQESSRKSPSERHVLGQPSRLVRQHNIQVPEILVTEEPDRDLEAQCHDQEKSEKFSWPQRSETLSKLPTEKLPPKKKRLRLAEIEHSSTESSFDSTLSRSLSRESSLSHTSSFSASLDIEDVSKTEASPKIDFLNKAEFLMIPAGLNTLNVPGCHREMRRTASEQINCTQTSMEVSDLRSKSFDCGSITPPQTTPLTELQPPSSPSRVGVTGHVPLLERRRGPLVRQISLNIAPDSHLSPVHPTSFQNTALPSVNAVPYQGPQLTSTSLAEFSANTLHSQTQVKDLQAETSNSSSTNVFPVQQLCDINLLNQIHAPPSHQSTQLSLQVSTQGSKPDKNSVLSGSSKSEDCFAPKYQLHCQVFTSGPSCSSNPVHSLPNQVISDPVGTDHCVTSATLPTKLIDSMSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTISSDSG

SEQ ID NO: 827201 - protein, 1110 aa, Homo sapiens
MSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 827202 - protein, 78 aa, Homo sapiens
RCWAAAGWRTERGTGERRPRGGYVCVWGCQVKEGSQAPPPPPRGSRDPEPRPPPSAAQLQGRLQRQRLRRASWQQHMD

SEQ ID NO: 827203 - protein, 443 aa, Homo sapiens
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 827204 - protein, 443 aa, Homo sapiens; identical to SEQ ID NO: 827203

SEQ ID NO: 827205 - protein, 381 aa, Homo sapiens
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYVRNLNNVPFPST

SEQ ID NO: 827206 - protein, 443 aa, Homo sapiens; identical to SEQ ID NO: 827203

SEQ ID NO: 827207 - protein, 443 aa, Homo sapiens; identical to SEQ ID NO: 827203

SEQ ID NO: 827208 - protein, 436 aa, Homo sapiens
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSPVKGAYREHPYGRY

SEQ ID NO: 827209 - protein, 443 aa, Homo sapiens; identical to SEQ ID NO: 827203

SEQ ID NO: 827210 - protein, 404 aa, Homo sapiens
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 827211 - protein, 321 aa, Homo sapiens
RTRAASFPVLSLAGSLGSASVATAPALPPPPTAARASVAAASLSRSLDRTSSQMQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPARTTGMGPGRR

SEQ ID NO: 827212 - protein, 443 aa, Homo sapiens; identical to SEQ ID NO: 827203

SEQ ID NO: 827213 - protein, 443 aa, Homo sapiens; identical to SEQ ID NO: 827203

SEQ ID NO: 827214 - protein, 443 aa, Homo sapiens; identical to SEQ ID NO: 827203

SEQ ID NO: 827215 - protein, 443 aa, Homo sapiens; identical to SEQ ID NO: 827203

SEQ ID NO: 827216 - protein, 443 aa, Homo sapiens; identical to SEQ ID NO: 827203

SEQ ID NO: 827217 - protein, 443 aa, Homo sapiens; identical to SEQ ID NO: 827203

SEQ ID NO: 827218 - protein, 381 aa, Homo sapiens; identical to SEQ ID NO: 827205

SEQ ID NO: 827219 - protein, 436 aa, Homo sapiens; identical to SEQ ID NO: 827208

SEQ ID NO: 827220 - protein, 151 aa, Homo sapiens
RGGARASPATQPPPLLPPSATGPDATVGGPAPTPLLPPSATASVKMEPENKYLPELMAEKDSLDPSFTHAMQLLTAGKGASRVPLGRPAIPGMSGPGFVPLASRPLGTEAVGSSGLILIFGSLDSTFPPQPGVRGRISRLQWRPEGDFAIP

SEQ ID NO: 827221 - protein, 536 aa, Homo sapiens
METMASPGKDNYRMKSYKNNALNPEEMRRRREEEGIQLRKQKREQQLFKRRNVELINEEAAMFDSLLMDSYVSSTTGESVITREMVEMLFSDDSDLQLATTQKFRKLLSKEPSPPIDEVINTPRVVDRFVEFLKRNENCTLQFEAAWALTNIASGTSQQTKIVIEAGAVPIFIELLNSDFEDVQEQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQIRYLVSLGCIKPLCDLLTVMDSKIVQVALNGLENILRLGEQEGKRSGSGVNPYCGLIEEAYGLDKIEFLQSHENQEIYQKAFDLIEHYFGVEDDDSSLAPQVDETQQQFIFQQPEAPMEGFQL

SEQ ID NO: 827222 - protein, 536 aa, Homo sapiens; identical to SEQ ID NO: 827221

SEQ ID NO: 827223 - protein, 536 aa, Homo sapiens; identical to SEQ ID NO: 827221

SEQ ID NO: 827224 - protein, 568 aa, Homo sapiens
LSMALLPASLSAVLEGEASVQDSPGSVMKSYVSETMASPGKDNYRMKSYKNNALNPEEMRRRREEEGIQLRKQKREQQLFKRRNVELINEEAAMFDSLLMDSYVSSTTGESVITREMVEMLFSDDSDLQLATTQKFRKLLSKEPSPPIDEVINTPRVVDRFVEFLKRNENCTLQFEAAWALTNIASGTSQQTKIVIEAGAVPIFIELLNSDFEDVQEQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQIRYLVSLGCIKPLCDLLTVMDSKIVQVALNGLENILRLGEQEGKRSGSGVNPYCGLIEEAYGLDKIEFLQSHENQEIYQKAFDLIEHYFGVEDDDSSLAPQVDETQQQFIFQQPEAPMEGFQL

SEQ ID NO: 827225 - protein, 533 aa, Homo sapiens
MASPGKDNYRMKSYKNNALNPEEMRRRREEEGIQLRKQKREQQLFKRRNVELINEEAAMFDSLLMDSYVSSTTGESVITREMVEMLFSDDSDLQLATTQKFRKLLSKEPSPPIDEVINTPRVVDRFVEFLKRNENCTLQFEAAWALTNIASGTSQQTKIVIEAGAVPIFIELLNSDFEDVQEQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQIRYLVSLGCIKPLCDLLTVMDSKIVQVALNGLENILRLGEQEGKRSGSGVNPYCGLIEEAYGLDKIEFLQSHENQEIYQKAFDLIEHYFGVEDDDSSLAPQVDETQQQFIFQQPEAPMEGFQL

SEQ ID NO: 827226 - protein, 536 aa, Homo sapiens; identical to SEQ ID NO: 827221

SEQ ID NO: 827227 - protein, 536 aa, Homo sapiens; identical to SEQ ID NO: 827221

SEQ ID NO: 827228 - protein, 536 aa, Homo sapiens; identical to SEQ ID NO: 827221

SEQ ID NO: 827229 - protein, 536 aa, Homo sapiens; identical to SEQ ID NO: 827221

SEQ ID NO: 827230 - protein, 750 aa, Homo sapiens
RNWASSGPFLLGLSLWRMGWMGEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 827231 - protein, 96 aa, Homo sapiens
AKAAGWRDGARPGAEPERKPQPGGGSGGSGGSRAGRAPWRQRRPPEQRGQQRRRRPDRAATPPGHGGRAVHAPGRRPAPAHRRKNREDPDGVPPVL

SEQ ID NO: 827232 - protein, 126 aa, Homo sapiens
REFVLVLREFVLVLRDFVLVLREFVLVLYENKAAYERQVPPRAVINSAGYKILTSVDQYLELIGNSLPGKGAPIPGHNALHRHLELARGGVALSPLLSAPCLRRDQLGLELWMETSLFAFRISLSP

SEQ ID NO: 827233 - protein, 810 aa, Homo sapiens
PRRPAGGTGPDRERSRSGSRSRAAGAAGAGEAGRAGLHGASGVRLSSAGNSGGVGRIGPRHLLAMGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 827234 - protein, 955 aa, Homo sapiens
PRRPAGGTGPDRERSRSGSRSRAAGAAGAGEAGRAGLHGASGVRLSSAGNSGGVGRIGPRHLLAMGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQGGSTRRGGDCCQEDAGGAAEKWWQLRGSAKAQRKAQTCTWGLGEAHSSLCGLRSSLSLASLCFSFFSRPWLCWEGQRSDEMTCGQQPGPGDSITALLLSATRPGMSHIPTTDPQGGMRRVFFEQSPAQGRLWDQCCVLTFPCGPVAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 827235 - protein, 438 aa, Homo sapiens
HPSSSGCLIQWHALIQWHALIQWHVLIQWHALIQWPSSSSMPSSSVMPSSSGIPSSSGKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 827236 - protein, 439 aa, Homo sapiens
RGCLSTALCHWTAPSMPSEPHASVLGPPGFTFVAMSTRWPSLVAGASPRAWTSRTQAKCVGGAAWPQGGPAQPPRPRPLQYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 827237 - protein, 327 aa, Homo sapiens
EFLWIVPSPPKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 827238 - protein, 201 aa, Homo sapiens
MKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 827239 - protein, 810 aa, Homo sapiens; identical to SEQ ID NO: 827233

SEQ ID NO: 827240 - protein, 810 aa, Homo sapiens; identical to SEQ ID NO: 827233

SEQ ID NO: 827241 - protein, 106 aa, Homo sapiens [sequence omitted]

SEQ ID NO: 827242 - protein, 810 aa, Homo sapiens; identical to SEQ ID NO: 827233

SEQ ID NO: 827243 - protein, 810 aa, Homo sapiens; identical to SEQ ID NO: 827233

SEQ ID NO: 827244 - protein, 810 aa, Homo sapiens; identical to SEQ ID NO: 827233

SEQ ID NO: 827245 - protein, 810 aa, Homo sapiens; identical to SEQ ID NO: 827233

SEQ ID NO: 827246 - protein, 715 aa, Homo sapiens
PRRPAGGTGPDRERSRSGSRSRAAGAAGAGEAGRAGLHGASGVRLSSAGNSGGVGRIGPRHLLAMGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEGLERIHGIVHLLPHVDLGSLLEHGRAGHIKSLLQPVQSQRLHLLIQLCIFRGCTTPGTE

SEQ ID NO: 827247 - protein, 645 aa, Homo sapiens
PRRPAGGTGPDRERSRSGSRSRAAGAAGAGEAGRAGLHGASGVRLSSAGNSGGVGRIGPRHLLAMGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPTERKG

SEQ ID NO: 827248 - protein, 617 aa, Homo sapiens
PRRPAGGTGPDRERSRSGSRSRAAGAAGAGEAGRAGLHGASGVRLSSAGNSGGVGRIGPRHLLAMGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSNHEEEMNALRGQVGGDVNVEMDAAPGVDLSRILNEMRDR

SEQ ID NO: 827249 - protein, 558 aa, Homo sapiens
PRRPAGGTGPDRERSRSGSRSRAAGAAGAGEAGRAGLHGASGVRLSSAGNSGGVGRIGPRHLLAMGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREVDPRLRPPPHTLSTAFHRPPRPGGPFCSVPSCHSHACLARSLLLCLEHLCLCPPG

SEQ ID NO: 827250 - protein, 515 aa, Homo sapiens
PRRPAGGTGPDRERSRSGSRSRAAGAAGAGEAGRAGLHGASGVRLSSAGNSGGVGRIGPRHLLAMGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEVRPAPPLGGGLLRVGLVCPRGPRLRDSGQPFPSKAVPVDGEGLLGTRGRGCEARAVGVLVGPAV

SEQ ID NO: 827251 - protein, 147 aa, Homo sapiens
PRRPAGGTGPDRERSRSGSRSRAAGAAGAGEAGRAGLHGASGVRLSSAGNSGGVGRIGPRHLLAMGDVLSTHLDDARRQHIAGQRSTSLWPWTPGVFSEFLEDGGMGLWFQQEKTGKILTEFLQFYEDQYGLVSGASLPSCPEDLRL

SEQ ID NO: 827252 - protein, 267 aa, Homo sapiens
RGTSPAGVGRVGGVGSSVDGSGGGGWEMAEYLASIFGTEKDKVNCSFYFKIGACRHGDRCSRLHNKPTFSQTIALLNIYRNPQNSSQSADGLRCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 827253 - protein, 68 aa, Homo sapiens
SGLADRPTSGPPSRRLPEAASSRAESCLEHPGLLDVDTFVPTFGCECPVEQALVPASPVFSRLSNLGS

SEQ ID NO: 827254 - protein, 532 aa, Homo sapiens
MRSGVQDQSGQHGEDPISTKDTKISWAWWQMPAIPASREAEAENRLNPGGGGCSELRSCRCTPAWAQSETPSPKKKKKTVWSCCCPFFLYFGRHPRRECTGIKRRVIFFPLRATKFECFSHFLEFLKSKLFKLFFQILFLISLFSLNSIWSAPCSCKSIVLRAFPKWGLQLALTPEFLTHQPRADPSNPCGGAPLKYGPWQKRLSVLSTHCLDTVSSSRRWNWFAPFRNRSKLGIQYDGTNIFLYWEILNLDCEYLPNDNFQRRRYHEMSMIGKFRKLKFDFYSHPTIESLEFSHLWIIKMNTWTLVKIRKSKPKIGTSHSPFCFKAVKIEVPLDIHKPKLSTPLNQSPSVNGVTDSGVADPRGHSPLELALHWVAWGLCFLAQWCTFLCVDEIFLSTFPAKTLNAFHANTDLIVEISFPESDGSRIYLVTLGLKYLFFCLFVFFLFFKEIRSIGGGKLFLYALIKKFLLTTLPWDKSEWKYMTEYTVINSSALIVYLGTVYAFLTDIECCISFHCVFICSSQHFCFAYATN

SEQ ID NO: 827255 - protein, 532 aa, Homo sapiens; identical to SEQ ID NO: 827254

SEQ ID NO: 827256 - protein, 270 aa, Homo sapiens
KKTTNTKEHGEDEEVRLNGRGDGSGGGGWEMAEYLASIFGTEKDKVNCSFYFKIGACRHGDRCSRLHNKPTFSQTIALLNIYRNPQNSSQSADGLRCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 827257 - protein, 532 aa, Homo sapiens; identical to SEQ ID NO: 827254

SEQ ID NO: 827258 - protein, 267 aa, Homo sapiens; identical to SEQ ID NO: 827252

SEQ ID NO: 827259 - protein, 532 aa, Homo sapiens; identical to SEQ ID NO: 827254

SEQ ID NO: 827260 - protein, 167 aa, Homo sapiens
MQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 827261 - protein, 167 aa, Homo sapiens; identical to SEQ ID NO: 827260

SEQ ID NO: 827262 - protein, 237 aa, Homo sapiens
MSDLREKNKRLAICKQIVSLQLSNICTAASRIPLFIFFSPQTILIQNIYRNPQNSAQTADGSHCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 827263 - protein, 532 aa, Homo sapiens; identical to SEQ ID NO: 827254

SEQ ID NO: 827264 - protein, 231 aa, Homo sapiens
APVSMTTCSRFIVQPRASVSMTTCSRLHNKPTFSQTIALLNIYRNPQNSSQSADGLRCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 827265 - protein, 270 aa, Homo sapiens
KKTTNTKEHGEDEEVRLNGRGDGSGGGGWEMAEYLASIFGTEKDKVNCSFYFKIGACRHGDRCSRLHNKPTFSQTILIQNIYRNPQNSAQTADGSHCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 827266 - protein, 257 aa, Homo sapiens
GGRLPRASAGSAASAAVSTAAAAAGGKWRSIWPPSSAPRKTKSTVHFISKLEHVVMETGALGCTINRRLASTESQLKHLPEAAGAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 827267 - protein, 532 aa, Homo sapiens; identical to SEQ ID NO: 827254

SEQ ID NO: 827268 - protein, 161 aa, Homo sapiens
MFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 827269 - protein, 219 aa, Homo sapiens
RGTSPAGVGRVGGVGSSVDGSGGGGWEMAEYLASIFGTEKDKVNCSFYFKIGACRHGDRCSRLHNKPTFSQTIALLNIYRNPQNSSQSADGLRCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKK

SEQ ID NO: 827270 - protein, 219 aa, Homo sapiens
RGTSPAGVGRVGGVGSSVDGSGGGGWEMAEYLASIFGTEKDKVNCSFYFKIGACRHGDRCSRLHNKPTFSQTILIQNIYRNPQNSAQTADGSHCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKK

SEQ ID NO: 827271 - protein, 106 aa, Homo sapiens
KKTTNTKEHGEDEEVRLNGRGDGSGGGGWEMAEYLASIFGTEKDKVNCSFYFKIGACRHGDRCSRLHNKPTFSQVCLPFFHVNYKNFMFFSKTVNFYILSKSFFLS

SEQ ID NO: 827272 - protein, 278 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARPRFKCLLDLNGEAKDPCTRWPQFKKKALTGATSQVGLREISRNVTPRKNAQNAKYWG

SEQ ID NO: 827273 - protein, 374 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 827274 - protein, 374 aa, Homo sapiens; identical to SEQ ID NO: 827273

SEQ ID NO: 827275 - protein, 374 aa, Homo sapiens; identical to SEQ ID NO: 827273

SEQ ID NO: 827276 - protein, 374 aa, Homo sapiens; identical to SEQ ID NO: 827273

SEQ ID NO: 827277 - protein, 374 aa, Homo sapiens; identical to SEQ ID NO: 827273

SEQ ID NO: 827278 - protein, 374 aa, Homo sapiens; identical to SEQ ID NO: 827273

SEQ ID NO: 827279 - protein, 374 aa, Homo sapiens; identical to SEQ ID NO: 827273

SEQ ID NO: 827280 - protein, 374 aa, Homo sapiens; identical to SEQ ID NO: 827273

SEQ ID NO: 827281 - protein, 374 aa, Homo sapiens; identical to SEQ ID NO: 827273

SEQ ID NO: 827282 - protein, 374 aa, Homo sapiens; identical to SEQ ID NO: 827273

SEQ ID NO: 827283 - protein, 374 aa, Homo sapiens; identical to SEQ ID NO: 827273

SEQ ID NO: 827284 - protein, 374 aa, Homo sapiens; identical to SEQ ID NO: 827273

SEQ ID NO: 827285 - protein, 374 aa, Homo sapiens; identical to SEQ ID NO: 827273

SEQ ID NO: 827286 - protein, 448 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEILIKIEAYGLSCWSNCEIRRRNYRSLTLPLGLCLRLRDDLHLEGEKKSGSLRMFLSCLSHLTVRNSKSGELILKVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 827287 - protein, 449 aa, Homo sapiens
MNLLVKQAGCSGRNPGRCGSKLSVKRRRTVTISCRRRISGMKSEEQIIIVDLLVRIERIVARNTYNMCDECQRELPESHPTIRTANVELARCRLESGSYYTIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 827288 - protein, 147 aa, Homo sapiens
MFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 827289 - protein, 121 aa, Homo sapiens
MMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 827290 - protein, 281 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKVR

SEQ ID NO: 827291 - protein, 335 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPHHRGGFHASHGFIVVHVGPVPFRPNLESLAPFPTGERELKSSLARPKINNYNINRTHKNKKRYIKTQRYIYIDKTQMTSGGTHSKYT

SEQ ID NO: 827292 - protein, 149 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEARVS

SEQ ID NO: 827293 - protein, 278 aa, Homo sapiens; identical to SEQ ID NO: 827272

SEQ ID NO: 827294 - protein, 916 aa, Homo sapiens
LGRAAWFYRRGQMDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827295 - protein, 248 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSENLAECLEKNRWTLSHKLHSGGSLKPGLTKKKYGKLLGLKMTVATRNYIQPVEVKNPIPNGAITDGFDGHMSAIWGMAPRYSRKTG

SEQ ID NO: 827296 - protein, 168 aa, Homo sapiens
MLNVFSFLSRAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKEVERKRRKRRTRNTKRIRSTRST

SEQ ID NO: 827297 - protein, 918 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827298 - protein, 693 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGDGLLLPPLLLDGAGLPHHHHDEGLLLLPHVGAHLLLEDTLLQYRGDTLLLHLQREERLHLLPLLNEEHHHLHHQSGGSPILHLPNKEAPQSPRDVHLHYHPSIGKGLPQAALPGRPDHHNQTNGIRPHHGLELLRPPQVLHPFEEERRHHPKEGSPRLQVLGPLGESPGLRNLKR

SEQ ID NO: 827299 - protein, 835 aa, Homo sapiens
MMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827300 - protein, 897 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHPAAIAAATTTLAQEEPVAAPEPKKETESEAEDNLDDLEKHLREKALRSMRKAQVSPQS

SEQ ID NO: 827301 - protein, 894 aa, Homo sapiens
RHEVCPKPVFAFHHANFPQYVMDVLMDQHFTVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827302 - protein, 935 aa, Homo sapiens
RTRGSTHASGSRSRGGKMDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827303 - protein, 835 aa, Homo sapiens; identical to SEQ ID NO: 827299

SEQ ID NO: 827304 - protein, 932 aa, Homo sapiens
KNPASILPPRSEIAPYPRVHRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827305 - protein, 918 aa, Homo sapiens; identical to SEQ ID NO: 827297

SEQ ID NO: 827306 - protein, 775 aa, Homo sapiens
MKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827307 - protein, 888 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827308 - protein, 805 aa, Homo sapiens
MMQINLTGFLNGKNAREFMGELWPLLLSAQENIAGIPSAFLELKKEEIKQRQIEQEKLASMKKQDEDKDKRDKEEKESSREKRERSRSPRRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827309 - protein, 776 aa, Homo sapiens
MLENLWENCGPCYKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827310 - protein, 587 aa, Homo sapiens
MPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827311 - protein, 641 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASP

SEQ ID NO: 827312 - protein, 587 aa, Homo sapiens; identical to SEQ ID NO: 827310

SEQ ID NO: 827313 - protein, 301 aa, Homo sapiens
MPRKKAPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827314 - protein, 907 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKEVERKRRKRRTRNTKRIRSTRST

SEQ ID NO: 827315 - protein, 891 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKVFMNSVY

SEQ ID NO: 827316 - protein, 824 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTLGTQSELKYLLEKQEQE

SEQ ID NO: 827317 - protein, 783 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPS

SEQ ID NO: 827318 - protein, 741 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSSQQHECIRGP

SEQ ID NO: 827319 - protein, 261 aa, Homo sapiens
LAEGRTYEFSEGGWNVPLGRLLWWCTVNEMKEDDELTPQTRMLTNVFFVLLEIYSFYALVEEAFFLAEFFFEEMTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827320 - protein, 179 aa, Homo sapiens [sequence omitted]

SEQ ID NO: 827321 - protein, 543 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPR

SEQ ID NO: 827322 - protein, 98 aa, Homo sapiens
DAWVDPRVRDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 827323 - protein, 498 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESGKFVVFFCDFGLFVFVFLKADFDFLHIWSSPSA

SEQ ID NO: 827324 - protein, 433 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSRCVGDGVCALSDADTIKDLLANCAIQGDLESRDCSRMVPAEKTRAESVELVLPP

SEQ ID NO: 827325 - protein, 383 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRTTFVSTPALGSQPHSSSFTLRPFDRATAYPSLEIR

SEQ ID NO: 827326 - protein, 109 aa, Homo sapiens
MDAGFFRGTSAEQDNRFSNKQKKLLKQLKFAECLEKKVDMSKVNLEVIKPWITKRVTEILGFEDDVVIEFIFNQLEVKALNQNGSYSLRLKYSTITLLGHSRVSVPMSL

SEQ ID NO: 827327 - protein, 696 aa, Homo sapiens
MRSGDKDHSGKHGEDTVSTKSIKISWMWWHVAVVSATREAAEAGESLEPGEAEVAVSRDHATTLESGDRMRLHLKKKKMICEMNLFENISLFSVVIHLKLVQSPFSFMCECIDNIVVLTTSFLISSSVFTEADERFPCILWWYDVALEHFSFEISAVFVYKYFGRSVDRMNEKQKLEVMVLVISGDFHVGKGTDKSEGIREFLILLSLVVFFDYFGELCLTVNEMIKMEKLVQKICLTLYRMSCFRHLLLDNICPFLYCYKEILDTGYFINKRDLLAHDSAGCTGNMILESAWLLERPQETENDDTRQRGSRHILHGRSREQERVKREVLHTFNNPDLSQAIAAYAYNPSTFGRPRQADHLRVRSSRPAWPTWCNLMSTKSTKISWVWLHLLIIPAAQEAEAGELLNPGGRCFSEPRLHHCTPAWVNRVRLCLKSKNKIKLKLKTRSCKNSLSEEQHQGYGAEPFMKEPSSRSSHLIPGPPPSNIGNYNFIMRVGGDMDPSHVTYYPDCSGLNNNFYLTIYFEYRHDLAVSLVQYLFKAVIRFFMCLSSTERLTEYGSEISQVIIGRIKFLFDSWSYFFTIYYSAFLPCSPFYGASHNTAACFIRASKQDKLQQMQVTWKSLLSNHGIDIVKNKSLGRLQIDQNMVIGQNHDCSGGCIMGSHFTSSTMGVMGDFITFVLLLRVESTLKMCKSVVCS

SEQ ID NO: 827328 - protein, 2557 aa, Homo sapiens
MTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEEELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFCGKHLSLIVRFPNQGRQVDELDIWSHTNDTIGSVRRCIVNRIKANVAHKKIELFVGGELIDSEDDRKLIGQLNLKDKSLITAKLTQINFNMPSSPDSSSDSSTASPGNHRNHYNDGPNLEVESCLPGVIMSVHPRYISFLWQVADLGSNLNMPPLRDGARVLMKLMPPDRTAVEKLRAVCLDHAKLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLFFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSESNVDPRDDVFGYPHQFEDKPALSKTEDRKEYNIGVLRHLQVIFGHLAASQLQYYVPRGFWKQFRLWGEPVNLREQHDALEFFNSLVDSLDEALKALGHPAILSKVLGGSFADQKICQGCPHRFECEESFTTLNVDIRNHQNLLDSLEQYIKGDLLEGANAYHCEKCDKKVDTVKRLLIKKLPRVLAIQLKRFDYDWERECAIKFNDYFEFPRELDMGPYTVAGVANLERDNVNSENELIEQKEQSDNETAGGTKYRLVGVLVHSGQASGGHYYSYIIQRNGKDDQTDHWYKFDDGDVTECKMDDDEEMKNQCFGGEYMGEVFDHMMKRMSYRRQKRWWNAYIPFYEQMDMIDEDDEMIRYISELTIARPHQIIMSPAIERSVRKQNVKFMHNRLQYSLEYFQFVKKLLTCNGVYLNPAPGQDYLLPEAEEITMISIQLAARFLFTTGFHTKKIVRGPASDCVLYDALCVLLRHSKNVRFWFTHNVLFNVSNRFSEYLLECPSAEVRGAFAKLIVFIAHFSLQDGSCPSPFASPGPSSQACDNLSLSDHLLRATLNLLRREVSEHGHHLQQYFNLFVMYANLGVAEKTQLLKLNVPATFMLVSLDEGPGPPIKYQYAELGKLYSVVSQLIRCCNVSSTMQSSINGNPPLPNPFGDLNLSQPIMPIQQNVLDILFVRTSYVKKIIEDCSNSEDTIKLLRFCSWENPQFSSTVLSELLWQVAYSYTYELRPYLDLLFQILLIEDSWQTHRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 827329 - protein, 2707 aa, Homo sapiens
MRLHLKKKKMICEMNLFENISLFSVVIHLKLVQSPFSFMCECIDNIVVLTTSFLISSSVFTEADERFPCILWWYDWPLEHFSFEISAVFVYKYFGRELGDNSGGCVEYVLEVLNFHSIYKAAIDRPFTDSSDNYIKRQKKEKRAKICAVSSMTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEEELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFCGKHLSLIVRFPNQGRQVDELDIWSHTNDTIGSVRRCIVNRIKANVAHKKIELFVGGELIDSEDDRKLIGQLNLKDKSLITAKLTQINFNMPSSPDSSSDSSTASPGNHRNHYNDGPNLEVESCLPGVIMSVHPRYISFLWQVADLGSNLNMPPLRDGARVLMKLMPPDRTAVEKLRAVCLDHAKLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLFFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSESNVDPRDDVFGYPHQFEDKPALSKTEDRKEYNIGVLRHLQVIFGHLAASQLQYYVPRGFWKQFRLWGEPVNLREQHDALEFFNSLVDSLDEALKALGHPAILSKVLGGSFADQKICQGCPHRFECEESFTTLNVDIRNHQNLLDSLEQYIKGDLLEGANAYHCEKCDKKVDTVKRLLIKKLPRVLAIQLKRFDYDWERECAIKFNDYFEFPRELDMGPYTVAGVANLERDNVNSENELIEQKEQSDNETAGGTKYRLVGVLVHSGQASGGHYYSYIIQRNGKDDQTDHWYKFDDGDVTECKMDDDEEMKNQCFGGEYMGEVFDHMMKRMSYRRQKRWWNAYIPFYEQMDMIDEDDEMIRYISELTIARPHQIIMSPAIERSVRKQNVKFMHNRLQYSLEYFQFVKKLLTCNGVYLNPAPGQDYLLPEAEEITMISIQLAARFLFTTGFHTKKIVRGPASDCLYDALCVLLRHSKNVRFWFTHNVLFNVSNRFSEYLLECPSAEVRGAFAKLIVFIAHFSLQDGSCPSPFASPGPSSQACDNLSLSDHLLRATLNLLRREVSEHGHHLQQYFNLFVMYANLGVAEKTQLLKLNVPATFMLVSLDEGPGPPIKYQYAELGKLYSVVSQLIRCCNVSSTMQSSINGNPPLPNPFGDLNLSQPIMPIQQNVLDILFVRTSYVKKIIEDCSNSEDTIKLLRFCSWENPQFSSTVLSELLWQVAYSYTYELRPYLDLLFQILLIEDSWQTHRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 827330 - protein, 2776 aa, Homo sapiens
MRSGDKDHSGKHGEDTVSTKSIKISWMWWHVAVVSATREAAEAGESLEPGEAEVAVSRDHATTLESGDRMRLHLKKKKMICEMNLFENISLFSVVIHLKLVQSPFSFMCECIDNIVVLTTSFLISSSVFTEADERFPCILWWYDVALEHFSFEISAVFVYKYFGRELGDNSGGCVEYVLEVLNFHSIYKAAIDRPFTDSSDNYIKRQKKEKRAKICAVSSMTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEEELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFCGKHLSLIVRFPNQGRQVDELDIWSHTNDTIGSVRRCIVNRIKANVAHKKIELFVGGELIDSEDDRKLIGQLNLKDKSLITAKLTQINFNMPSSPDSSSDSSTASPGNHRNHYNDGPNLEVESCLPGVIMSVHPRYISFLWQVADLGSNLNMPPLRDGARVLMKLMPPDRTAVEKLRAVCLDHAKLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLFFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSESNVDPRDDVFGYPHQFEDKPALSKTEDRKEYNIGVLRHLQVIFGHLAASQLQYYVPRGFWKQFRLWGEPVNLREQHDALEFFNSLVDSLDEALKALGHPAILSKVLGGSFADQKICQGCPHRFECEESFTTLNVDIRNHQNLLDSLEQYIKGDLLEGANAYHCEKCDKKVDTVKRLLIKKLPRVLAIQLKRFDYDWERECAIKFNDYFEFPRELDMGPYTVAGVANLERDNVNSENELIEQKEQSDNETAGGTKYRLVGVLVHSGQASGGHYYSYIIQRNGKDDQTDHWYKFDDGDVTECKMDDDEEMKNQCFGGEYMGEVFDHMMKRMSYRRQKRWWNAYIPFYEQMDMIDEDDEMIRYISELTIARPHQIIMSPAIERSVRKQNVKFMHNRLQYSLEYFQFVKKLLTCNGVYLNPAPGQDYLLPEAEEITMISIQLAARFLFTTGFHTKKIVRGPASDWWYDALCVLLRHSKNVRFWFTHNVLFNVSNRFSEYLLECPSAEVRGAFAKLIVFIAHFSLQDGSCPSPFASPGPSSQACDNLSLSDHLLRATLNLLRREVSEHGHHLQQYFNLFVMYANLGVAEKTQLLKLNVPATFMLVSLDEGPGPPIKYQYAELGKLYSVVSQLIRCCNVSSTMQSSINGNPPLPNPFGDLNLSQPIMPIQQNVLDILFVRTSYVKKIIEDCSNSEDTIKLLRFCSWENPQFSSTVLSELLWQVAYSYTYELRPYLDLLFQILLIEDSWQTHRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 827331 - protein, 2265 aa, Homo sapiens
MRLHLKKKKMICEMNLFENISLFSVVIHLKLVQSPFSFMCECIDNIVVLTTSFLISSSVFTEADERFPCILWWYDWPLEHFSFEISAVFVYKYFGRELGDNSGGCVEYVLEVLNFHSIYKAAIDRPFTDSSDNYIKRQKKEKRAKICAVSSMTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEEELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFCGKHLSLIVRFPNQGRQVDELDIWSHTNDTIGSVRRCIVNRIKANVAHKKIELFVGGELIDSEDDRKLIGQLNLKDKSLITAKLTQINFNMPSSPDSSSDSSTASPGNHRNHYNDGPNLEVESCLPGVIMSVHPRYISFLWQVADLGSNLNMPPLRDGARVLMKLMPPDRTAVEKLRAVCLDHAKLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLFFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSESNVDPRDDVFGYPHQFEDKPALSKTEDRKEYNIGVLRHLQVIFGHLAASQLQYYVPRGFWKQFRLWGEPVNLREQHDALEFFNSLVDSLDEALKALGHPAILSKVLGGSFADQKICQGCPHRFECEESFTTLNVDIRNHQNLLDSLEQYIKGDLLEGANAYHCEKCDKKVDTVKRLLIKKLPRVLAIQLKRFDYDWERECAIKFNDYFEFPRELDMGPYTVAGVANLERDNVNSENELIEQKEQSDNETAGGTKYRLVGVLVHSGQASGGHYYSYIIQRNGKDDQTDHWYKFDDGDVTECKMDDDEEMKNQCFGGEYMGEVFDHMMKRMSYRRQKRWWNAYIPFYEQMDMIDEDDEMIRYISELTIARPHQIIMSPAIERSVRKQNVKFMHNRLQYSLEYFQFVKKLLTCNGVYLNPAPGQDYLLPEAEEITMISIQLAARFLFTTGFHTKKIVRGPASDCVGMMHCAFFSVTAKMYVFGLLIMSFLMYQIASLNTSWSALVQK

SEQ ID NO: 827332 - protein, 1845 aa, Homo sapiens
MRLHLKKKKMICEMNLFENISLFSVVIHLKLVQSPFSFMCECIDNIVVLTTSFLISSSVFTEADERFPCILWWYDWPLEHFSFEISAVFVYKYFGRELGDNSGGCVEYVLEVLNFHSIYKAAIDRPFTDSSDNYIKRQKKEKRAKICAVSSMTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEEELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFCGKHLSLIVRFPNQGRQVDELDIWSHTNDTIGSVRRCIVNRIKANVAHKKIELFVGGELIDSEDDRKLIGQLNLKDKSLITAKLTQINFNMPSSPDSSSDSSTASPGNHRNHYNDGPNLEVESCLPGVIMSVHPRYISFLWQVADLGSNLNMPPLRDGARVLMKLMPPDRTAVEKLRAVCLDHAKLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLFFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSEVNFNTVFFEESDSRCCCSPSDYYTFMGCYGDYILMIQTESLRYYVWHTCSTHYVIDLKLQLIIKHCFFVCLQSTVNIIAFCVTW

SEQ ID NO: 827333 - protein, 812 aa, Homo sapiens
MRLHLKKKKMICEMNLFENISLFSVVIHLKLVQSPFSFMCECIDNIVVLTTSFLISSSVFTEADERFPCILWWYDWPLEHFSFEISAVFVYKYFGRELGDNSGGCVEYVLEVLNFHSIYKAAIDRPFTDSSDNYIKRQKKEKRAKICAVSSMTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEEELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGEFCSCCTGRLECNGTISAHCKVCPPGNY

SEQ ID NO: 827334 - protein, 1556 aa, Homo sapiens
MDQLALQWEELIEARLTIGLVILLPENALRQLCQAESTRKVLRMELVPHGTDTTASDGLPTPMAERSPAVMVMELTEWTSIQFKEGASRKTGEAVPTNKALWVARQCPWLKGSFPTLGDCSHHTWVRTWLRNPFGNIASCPSHESLLHQTPLRSESRRSALGARSGSLLSALYPGWEQRSKHSVEKKVGGSRWGSRPSHSAQRRDWSQSLLCNEYRQNAQDAMIALEHGSPSQQSVSGRMHNGPWALWQCQGPAIPAPDPQALSPGRPCDPACLAKCFLPASALTATLACISVEVSHELIQLEQLLTFYEGGGDSFGSWASTVDIELLDIGSIHELRRQGTCVILNRKDLRSLIKVSLLSGIADPGEEELGWNIHHCPEGWSVPVPPIRHLTLPLSYIQDALVSQAVRNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRQEGCLRPRVRDQSWKHSETMSLRKLK

SEQ ID NO: 827335 - protein, 53 aa, Homo sapiens
WVLGSGEQASCHTFTLLGEANHGALQFGDIPTSHLLFKLPQELLKPRYYLAFL

SEQ ID NO: 827336 - protein, 1729 aa, Homo sapiens
TSRNRDASSSEAVSCSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 827337 - protein, 1813 aa, Homo sapiens
PTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 827338 - protein, 1008 aa, Homo sapiens
MHNLTFLFFFSPTVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 827339 - protein, 685 aa, Homo sapiens
ARTPEPSMRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 827340 - protein, 261 aa, Homo sapiens
MIPWTLKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 827341 - protein, 1773 aa, Homo sapiens
PTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAANLTTLRIPVWKSFFGCLRNIHVNHIPVPVTEALEVQGPVSLNGCPDQ

SEQ ID NO: 827342 - protein, 1607 aa, Homo sapiens
PTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKVQVETQALKG

SEQ ID NO: 827343 - protein, 1636 aa, Homo sapiens
PTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDRGCLVLVKKKKKKKKVETYSSH

SEQ ID NO: 827344 - protein, 1339 aa, Homo sapiens
PTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSG

SEQ ID NO: 827345 - protein, 202 aa, Homo sapiens
PHNNTAYSDCQKNGSVWMQRAVPYALGKLLSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 827346 - protein, 139 aa, Homo sapiens
SRGSLKASRVALMCYLKAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 827347 - protein, 1051 aa, Homo sapiens
TSRNRDASSSEAVSCSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTPLSFGSSEFSLYLTMSLPSSIFRDMKRSPFSAKNSKPLSTVV

SEQ ID NO: 827348 - protein, 780 aa, Homo sapiens
TSRNRDASSSEAVSCSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQLSVPTRVLLQMLSGKIAPSCFSHGII

SEQ ID NO: 827349 - protein, 478 aa, Homo sapiens
TSRNRDASSSEAVSCSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQEKKKKKKKKKLGGARAAGPPRKALF

SEQ ID NO: 827350 - protein, 376 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 827351 - protein, 172 aa, Homo sapiens [sequence omitted]

SEQ ID NO: 827352 - protein, 382 aa, Homo sapiens
MLKKISVGVAGDLNTVTMKLGCVLMAWALYLSLGVLWVAQMLLAAGCHAAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 827353 - protein, 198 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQGQLPASSSPSTRMEG

SEQ ID NO: 827354 - protein, 236 aa, Homo sapiens
MLKKISVGVAGDLNTVTMKLGCVLMAWALYLSLGVLWVAQMLLELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 827355 - protein, 204 aa, Homo sapiens
MLKKISVGVAGDLNTVTMKLGCVLMAWALYLSLGVLWVAQMLLAAGCHAAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQGQLPASSSPSTRMEG

SEQ ID NO: 827356 - protein, 287 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 827357 - protein, 281 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 827358 - protein, 135 aa, Homo sapiens
GRGTQSWAISVEGHLSQWPVLPGLERKPASVVAITVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 827359 - protein, 287 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGEFASECRL

SEQ ID NO: 827360 - protein, 192 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 827361 - protein, 82 aa, Homo sapiens
VKADPAGHSWALFSGSGEYSEPCILSREAELLSNARPATQTLWQKPVLWAASQNGGGASSVDAGLCPRSWLDTAHTCCLGIR

SEQ ID NO: 827362 - protein, 122 aa, Homo sapiens
ASRLPFIEHLLCARHFTHMLPVCTHDNPVGQGLIITSKETGVHVPKVMLQIGGRTGAQTPEPDFLTRGHAGPHCTPALQPTRPIPVQAGRVLLGEWPPSPWPWLLPLEDTGIWAGEQEPGVG

SEQ ID NO: 827363 - protein, 238 aa, Homo sapiens
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 827364 - protein, 275 aa, Homo sapiens
MLGGVTLKLFYLLPRTAASGARSRPEPGTQVRSLNFRMLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 827365 - protein, 238 aa, Homo sapiens; identical to SEQ ID NO: 827363

SEQ ID NO: 827366 - protein, 194 aa, Homo sapiens
ARYEAWGESAEAVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 827367 - protein, 203 aa, Homo sapiens
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKDLY

SEQ ID NO: 827368 - protein, 238 aa, Homo sapiens; identical to SEQ ID NO: 827363

SEQ ID NO: 827369 - protein, 238 aa, Homo sapiens; identical to SEQ ID NO: 827363

SEQ ID NO: 827370 - protein, 110 aa, Homo sapiens
MLQISYFRDPYHVWYQGNASLGGHLTHVLEGPDTFTLQQLNAYNRTRYELREFLEDTCVQYVQKHISAENTKGSQTSRSYTSLVLGVLVGSFIIAGVAVGIFLCTGGRRC

SEQ ID NO: 827371 - protein, 249 aa, Homo sapiens
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGMMGRGPGLQAGERAGSRQMDGPEGWMPREARNGLSLRAFGVGVALSIT

SEQ ID NO: 827372 - protein, 695 aa, Homo sapiens
MDTSTQWAIYIYLLNGNGSIQNYLGCWLKISRIIQFLFIWNLIVQFGVSDVTKILMTYIIGVILKFIRCSASSMMIVYWRKCTMHTDLPRSEKTDVNLQHYLIISNCCMNTHTNTHPQNSHYKIGGQIMTFDKNELLQSSTSLSFLPNILTGYSIHRLLSQCTCYPNTSRHLTGIQEHFVKKEKNKPKKKKSREFPSCFTTSQLQKNQACPCLVPDGSASRVNELEQISGFKMPPNIIWADELTWLDIVLPATGNVLFLLEALTATATVKYQEPPKFFLISLRVNIRHIKNNNPIIKPCEVFLGASSIALIRLRTTHSHPSHLSSLFTHTPSGILLSIKKYVIKIETTKDLSLFTVLSNIYLPSLVSKQRSTLVLIKAGMMLIISEVWDCFVYNKGLLKAEIVRRPGPRSHLPVCVSSVRVSSLRMAEADVSLSQKVFFALFCFVWFLSPRFYCPFYGLELNGSTMQFALLLLSTNSHDEPELEVKPPHKEHGRKIATVRSQTLATGNFSGSEYPSYLRGTAYFSPYLSYYKPKWEPFRLSNKLLKIENVGLNRLPAAKCDEETCHLEATTAGRAGRESPGSPGVGREDKQERKRRPGLSTTARSRHFTAKPKSLHTVEHSSLDFRRGTCEAGTPCRFCFHDLYSAMKWEQVDYVFFFFFNGVSILSPRLECSGVISVHCNLCHPCSSDSPASAP

SEQ ID NO: 827373 - protein, 711 aa, Homo sapiens
MGVFKIIWVVGFKISRIIQFLFIWNLIVQFGVSDVTKILMTYIIGVILKFIRCSASSMMIVYWRKCTMHTDLPRSEKTDVNLQHYLIISNCCMNTHTNTHPQNSHYKIGGQIMTFDKNELLQSSTSLSFLPNILTGYSIHRLLSQCTCYPNTSRHLTGIQEHFVKKEKNKPKKKKSREFPSCFTTSQLQKNQACPCLVPDGSASRVNELEQISGFKMPPNIIWADELTWLDIVLPATGNVLFLLEALTATATVKYQEPPKFFLISLRVNIRHIKNNNPIIKPCEVFLGASSIALIRLRTTHSHPSHLSSLFTHTPSGILLSIKKYVIKIENNKRPFIIYSVKNIYLPSLVSKQRSTLVLIKAGMMLIISEVWDCFVYNKGLLKAEIVRRPGPRSHLPVCVSSVRVSSLRMAEADVSLSQKVFFALFCFVWFLSPRFYCPFYGLELNGSTMQFALLLLSTNSHDEAIIRSKTTTINNMVEKLPQGEARLWRRETSAGPEYPSYLRGTAYFSPYLSYYKPKWEPFRLSNKLLKIENVGLNRLPAAKCDEETCHLEATTAGRAGRESPGSPGVGREDKQERKRRPGLSTTARSRHFTAKPKSLHTVEHSSLDFRRGTCEAGTPCRFCFHDLYSAMKWEQVDKFFFFFLMESHSVTQAGVQWRDLGSLQPLPPMFKRFSCLSPLSSWDYRCLPLRLANFCIFSRDGVSPSWPGWS

SEQ ID NO: 827374 - protein, 195 aa, Homo sapiens
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPEGPYGVFAGRDASRGLATFCLDKEALKDEYDDLSDLTAAQQETLSDWESQFTFKYHHVGKLLKEGEEPTVYSDEEEPKDESARKND

SEQ ID NO: 827375 - protein, 195 aa, Homo sapiens; identical to SEQ ID NO: 827374

SEQ ID NO: 827376 - protein, 195 aa, Homo sapiens; identical to SEQ ID NO: 827374

SEQ ID NO: 827377 - protein, 143 aa, Homo sapiens
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPVKYHHVGKLLKEGEEPTVYSDEEEPKDESARKND

SEQ ID NO: 827378 - protein, 193 aa, Homo sapiens
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPEGPYGVFAGRDASRGLATFCLDKEALKDEYDDLSDLTAAQQETLSDWESQFTFKYHHVGKLLKEGEEPTVYSDEEEPKDESARN

SEQ ID NO: 827379 - protein, 195 aa, Homo sapiens; identical to SEQ ID NO: 827374

SEQ ID NO: 827380 - protein, 196 aa, Homo sapiens
TSLLSNARPSGLASVASHIDVTLELLPQRGRRDRLSPHLPPYSPLYSRFDHLSPSAAPSHFGQSQAPIRLPPPPGAPSISLSPLPQNLCKGYERDPLPSRCIGGNVTGRCGIGTSLPVRARVVRNQNNPLPFISPRIQSLGARLGREWHGDVGRPFKLRTERKNIVFSLSECAWVTLRAPSSSARRKAALRLRVAD

SEQ ID NO: 827381 - protein, 213 aa, Homo sapiens
TSLLSNARPSGLASVASHIDVTLELLPQRGRRDRLSPHLPPYSPLYSRFDHLSPSAAPSHFGQSQAPIRLPPPPGAPSISLSPLPQNLCKGYERDPLPSRPPLRAVRSKKQKLVGGWLGLCPVPRWINCLFSHPLLVPDLLCPRGQTHCAVFCQSVAQHQALPAPVPDRARRTAWSAGLQSPSAVFRGSRDVSGVIAQRQTSQEKELESGLLS

SEQ ID NO: 827382 - protein, 366 aa, Homo sapiens
MTVRNIASICNMGTNASALEKDIGPEQFPINEHYFGLVNFGNTCYCNSVLQALYFCRPFRENVLAYKAQQKKKENLLTCLADLFHSIATQKKKVGVIPPKKFISRLRKENDLFDNYMQQDAHEFLNYLLNTIADILQEEKKQEKQNGKLKNGNMNEPAENNKPELTWVHEIFQGTLTNETRCLNCETVSSKDEDFLDLSVDVEQNTSITHCLRDFSNTETLCSEQKYYCETCCSKQEAQKRMRVKKLPMILALHLKRFKYMEQLHRYTKLSYRVVFPLELRLFNTSSDAVNLDRMYDLVAVVVHCGSGPNRGHYITIVKSHGFWLLFDDDIVEKIDAQAIEEFYGLTSDISKNSESGYILFYQSRE

SEQ ID NO: 827383 - protein, 366 aa, Homo sapiens; identical to SEQ ID NO: 827382

SEQ ID NO: 827384 - protein, 366 aa, Homo sapiens; identical to SEQ ID NO: 827382

SEQ ID NO: 827385 - protein, 341 aa, Homo sapiens
MTVRNIASICNMGTNASALEKDIGPEQFPINEHYFGLVNFGNTCYCNSVLQALYFCRPFRENVLAYKAQQKKKENLLTCLADLFHSIATQKKKVGVIPPKKFISRLRKENDLFDNYMQQDAHEFLNYLLNTIADILQEEKKQEKQNGKLKNGNMNEPAENNKPELTWVHEIFQGTLTNETRCLNCETVSSKDEDFLDLSVDVEQNTSITHCLRDFSNTETLCSEQKYYCETCCSKQEAQKRMRVKKLPMILALHLKRFKYMEQLHRYTKLSYRVVFPLELRLFNTSSDAVNLDRMYDLVAVVVHCGSGPNRGHYITIVKSHGFWLLFDDDIVEVGLQIILQ

SEQ ID NO: 827386 - protein, 369 aa, Homo sapiens
MPLLWKKTLVQSSFQSMNTISDWSMSCPLNWGQALLKGVWGKFGNTCYCNSVLQALYFCRPFRENVLAYKAQQKKKENLLTCLADLFHSIATQKKKVGVIPPKKFISRLRKENDLFDNYMQQDAHEFLNYLLNTIADILQEEKKQEKQNGKLKNGNMNEPAENNKPELTWVHEIFQGTLTNETRCLNCETVSSKDEDFLDLSVDVEQNTSITHCLRDFSNTETLCSEQKYYCETCCSKQEAQKRMRVKKLPMILALHLKRFKYMEQLHRYTKLSYRVVFPLELRLFNTSSDAVNLDRMYDLVAVVVHCGSGPNRGHYITIVKSHGFWLLFDDDIVEKIDAQAIEEFYGLTSDISKNSESGYILFYQSRE

SEQ ID NO: 827387 - protein, 161 aa, Homo sapiens
MTVRNIASICNMGTNASALEKDIGPEQFPINEHYFGLVNFGNTCYCNSVLQALYFCRPFRENVLAYKAQQKKKENLLTCLADLFHSIATQKKKVGVIPPKKFISRLRKENDLFDNYMQQDAHEFLNYLLNTIADILQEEKKQEKQNGKLNQDAEGEQDCWP

SEQ ID NO: 827388 - protein, 165 aa, Homo sapiens
MAESHQEILILLRQSTCYKGLRRLLSKQETGTEFSQELRQLVGLLSPMVYQEVEEQKLHQAACLIQAYWKGFQTRKRLKKLPSAVIALQRSFRSKRSKMLLEINRQKEEEDLKLQLQLQRQRAMRLSQELWLSMLKVVHPGQVEKHNWEMEEKSALIIQKHWRGY

SEQ ID NO: 827389 - protein, 981 aa, Homo sapiens
PPSSPAGPLPGGIIWSPAMDAPKAGYAFEYLIETLNDSSHKKFFDVSKLGTKYDVLPYSIRVLLEAAVRNCDGFLMKKEDVMNILDWKTKQSNVEVPFFPARVLLQDFTGIPAMVDFAAMREAVKTLGGDPEKVHPACPTDLTVDHSLQIDFSKCAIQNAPNPGGGDLQKAGKLSPLKVQPKKLPCRGQTTCRGSCDSGELGRNSGTFSSQIENTPILCPFHLQPVPEPETVLKNQEVEFGRNRERLQFFKWSSRVFKNVAVIPPGTGMAHQINLEYLSRVVFEEKDLLFPDSVVGTDSHITMVNGLGILGWGVGGIETEAVMLGLPVSLTLPEVVGCELTGSSNPFVTSIDVVLGITKHLRQVGVAGKFVEFFGSGVSQLSIVDRTTIANMCPEYGAILSFFPVDNVTLKHLEHTGFSKAKLESMETYLKAVKLFRNDQNSSGEPEYSQVIQINLNSIVPSVSGPKRPQDRVAVTDMKSDFQACLNEKVGFKGFQIAAEKQKDIVSIHYEGSEYKLSHGSVVIAAVISCTNNCNPSVMLAAGLLAKKAVEAGLRVKPYIRTSLSPGSGMVTHYLSSSGVLPYLSKLGFEIVGYGCSTCVGNTAPLSDAVLNAVKQGDLVTCGILSGNKNFEGRLCDCVRANYLASPPLVVAYAIAGTVNIDFQTEPLGTDPTGKNIYLHDIWPSREEVHRVEEEHVILSMFKALKDKIEMGNKRWNSLEAPDSVLFPWDLKSTYIRCPSFFDKLTKEPIALQAIENAHVLLYLGDSVTTDHISPAGSIARNSAAAKYLTNRGLTPREFNSYGARRGNDAVMTRGTFANIKLFNKFIGKPAPKTIHFPSGQTLDVFEAAELYQKEGIPLIILAGKKYGSGNSRDWAAKGPYLLGVKAVLAESYEKIHKDHLIGIGIAPLQFLPGENADSLGLSGRETFSLTFPEELSPGITLNIQTSTGKVFSVIASFEDDVEITLYKHGGLLNFVARKFS

SEQ ID NO: 827390 - protein, 981 aa, Homo sapiens; identical to SEQ ID NO: 827389

SEQ ID NO: 827391 - protein, 659 aa, Homo sapiens [sequence omitted]

SEQ ID NO: 827392 - protein, 713 aa, Homo sapiens
MAHQINLEYLSRVVFEEKDLLFPDSVVGTDSHITMVNGLGILGWGVGGIETEAVMLGLPVSLTLPEVVGCELTGSSNPFVTSIDVVLGITKHLRQVGVAGKFVEFFGSGVSQLSIVDRTTIANMCPEYGAILSFFPVDNVTLKHLEHTGFSKAKLESMETYLKAVKLFRNDQNSSGEPEYSQVIQINLNSIVPSVSGPKRPQDRVAVTDMKSDFQACLNEKVGFKGFQIAAEKQKDIVSIHYEGSEYKLSHGSVVIAAVISCTNNCNPSVMLAAGLLAKKAVEAGLRVKPYIRTSLSPGSGMVTHYLSSSGVLPYLSKLGFEIVGYGCSTCVGNTAPLSDAVLNAVKQGDLVTCGILSGNKNFEGRLCDCVRANYLASPPLVVAYAIAGTVNIDFQTEPLGTDPTGKNIYLHDIWPSREEVHRVEEEHVILSMFKALKDKIEMGNKRWNSLEAPDSVLFPWDLKSTYIRCPSFFDKLTKEPIALQAIENAHVLLYLGDSVTTDHISPAGSIARNSAAAKYLTNRGLTPREFNSYGARRGNDAVMTRGTFANIKLFNKFIGKPAPKTIHFPSGQTLDVFEAAELYQKEGIPLIILAGKKYGSGNSRDWAAKGPYLLGVKAVLAESYEKIHKDHLIGIGIAPLQFLPGENADSLGLSGRETFSLTFPEELSPGITLNIQTSTGKVFSVIASFEDDVEITLYKHGGLLNFVARKFS

SEQ ID NO: 827393 - protein, 281 aa, Homo sapiens [sequence omitted]

SEQ ID NO: 827394 - protein, 981 aa, Homo sapiens; identical to SEQ ID NO: 827389

SEQ ID NO: 827395 - protein, 953 aa, Homo sapiens
PPSSPAGPLPGGIIWSPAMDAPKAGYAFEYLIETLNDSSHKKFFDVSKLGTKYDVLPYSIRVLLEAAVRNCDGFLMKKEDVMNILDWKTKQSNVEVPFFPARVLLQDFTGIPAMVDFAAMREAVKTLGGDPEKVHPACPTDLTVDHSLQIDFSKCAIQNAPNPGGGDLQKAGKLSPLKVQPKKLPCRGQTTCRGSCDSGELGRNSGTFSSQIENTPILCPFHLQPVPEPETVLKNQEVEFGRNRERLQFFKWSSRVFKNVAVIPPGTGMAHQINLEYLSRVVFEEKDLLFPDSVVGTDSHITMVNGLGILGWGVGGIETEAVMLGLPVSLTLPEVVGCELTGSSNPFVTSIDVVLGITKHLRQVGVAGKFVEFFGSGVSQLSIVDRTTIANMCPEYGAILSFFPVDNVTLKHLEHTGFSKAKLESMETYLKAVKLFRNDQNSSGEPEYSQVIQINLNSIVPSVSGPKRPQDRVAVTDMKSDFQACLNEKVGFKGFQIAAEKQKDIVSIHYEGSEYKLSHGSVVIAAVISCTNNCNPSVMLAAGLLAKKAVEAGLRVKPYIRTSLSPGSGMVTHYLSSSGVLPYLSKLGFEIVGYGCSTCVGNTAPLSDAVLNAVKQGDLVTCGILSGNKNFEGRLCDCVRANYLASPPLVVAYAIAGTVNIDFQTEPLGTDPTGKNIYLHDIWPSREEVHRVEEEHVILSMFKALKDKIEMGNKRWNSLEAPDSVLFPWDLKSTYIRCPSFFDKLTKEPIALQAIENAHVLLYLGDSVTTDHISPAGSIARNSAAAKYLTNRGLTPREFNSYGARRGNDAVMTRGTFANIKLFNKFIGKPAPKTIHFPSGQTLDVFEAAELYQKEGIPLIILAGKKYGSGNSRDWAAKGPYLLGVKAVLAESYEKIHKDHLIGIGIAPLQFLPGENADSLGLSGRETFSLTFPEELSPGITLNIQVSLNFSNI

SEQ ID NO: 827396 - protein, 50 aa, Homo sapiens
MVDFAAMREAVKTLGGDPEKVHPACPTDLTVDHSLQIDFSKWYFNADIYR

SEQ ID NO: 827397 - protein, 72 aa, Homo sapiens
IARATVLEAAVSCDHTTALQPGQQSETLFLKERKKKGCHLNRHTIELRYPDFKDMKMLIIATLSFQAPFYPD

SEQ ID NO: 827398 - protein, 165 aa, Homo sapiens
MASGVQVADEVCRIFYDMKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 827399 - protein, 165 aa, Homo sapiens; identical to SEQ ID NO: 827398

SEQ ID NO: 827400 - protein, 165 aa, Homo sapiens; identical to SEQ ID NO: 827398

SEQ ID NO: 827401 - protein, 104 aa, Homo sapiens
MASGVQVADEVCRIFYDMKVRKCSTPEEIKKRKKAVIFCLSADKKCIIVEEGKEILVGDVGVTITDPFKHFVGMLPEKDCRYALYDASFETKESRKEELMFFLW

SEQ ID NO: 827402 - protein, 165 aa, Homo sapiens; identical to SEQ ID NO: 827398

SEQ ID NO: 827403 - protein, 165 aa, Homo sapiens; identical to SEQ ID NO: 827398

SEQ ID NO: 827404 - protein, 165 aa, Homo sapiens; identical to SEQ ID NO: 827398

SEQ ID NO: 827405 - protein, 165 aa, Homo sapiens; identical to SEQ ID NO: 827398

SEQ ID NO: 827406 - protein, 165 aa, Homo sapiens; identical to SEQ ID NO: 827398

SEQ ID NO: 827407 - protein, 148 aa, Homo sapiens
MKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 827408 - protein, 165 aa, Homo sapiens; identical to SEQ ID NO: 827398

SEQ ID NO: 827409 - protein, 181 aa, Homo sapiens
KYTGSLLMEMLVYYSFPASGVQVADEVCRIFYDMKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 827410 - protein, 165 aa, Homo sapiens; identical to SEQ ID NO: 827398

SEQ ID NO: 827411 - protein, 165 aa, Homo sapiens; identical to SEQ ID NO: 827398

SEQ ID NO: 827412 - protein, 168 aa, Homo sapiens
MASGVQVADEVCRIFYDMKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIIIQCHKLKASMFNVILLLYK

SEQ ID NO: 827413 - protein, 73 aa, Homo sapiens
MIEVVCNDRLGKKVRVKCNTDDTIGDLKKLIAAQTGTRWNKIVLKKWYTIFKDHVSLGDYEIHDGMNLELYYQ

SEQ ID NO: 827414 - protein, 127 aa, Homo sapiens
LGHLWGYESTWLLGFIINSEILIFLPVSSPILIPHTGIERGGVGRFEAIRAPARMIEVVCNDRLGKKVRVKCNTDDTIGDLKKLIAAQTGTRWNKIVLKKWYTIFKDHVSLGDYEIHDGMNLELYYQ

SEQ ID NO: 827415 - protein, 93 aa, Homo sapiens
RRRQKGEGGVGFEAIRAPARMIEVVCNDRLGKKVRVKCNTDDTIGDLKKLIAAQTGTRWNKIVLKKWYTIFKDHVSLGDYEIHDGMNLELYYQ

SEQ ID NO: 827416 - protein, 72 aa, Homo sapiens
LFKSKAPFWGKKFRVKCNTDDTIGDLKKLIAAQTGTRWNKIVLKKWYTIFKDHVSLGDYEIHDGMNLELYYQ

SEQ ID NO: 827417 - protein, 127 aa, Homo sapiens; identical to SEQ ID NO: 827414

SEQ ID NO: 827418 - protein, 73 aa, Homo sapiens; identical to SEQ ID NO: 827413

SEQ ID NO: 827419 - protein, 73 aa, Homo sapiens; identical to SEQ ID NO: 827413

SEQ ID NO: 827420 - protein, 101 aa, Homo sapiens
TSNLPTPPAPHPSAEPRSQFGAIRAPARMIEVVCNDRLGKKVRVKCNTDDTIGDLKKLIAAQTGTRWNKIVLKKWYTIFKDHVSLGDYEIHDGMNLELYYQ

SEQ ID NO: 827421 - protein, 73 aa, Homo sapiens; identical to SEQ ID NO: 827413

SEQ ID NO: 827422 - protein, 73 aa, Homo sapiens; identical to SEQ ID NO: 827413

SEQ ID NO: 827423 - protein, 73 aa, Homo sapiens; identical to SEQ ID NO: 827413

SEQ ID NO: 827424 - protein, 73 aa, Homo sapiens; identical to SEQ ID NO: 827413

SEQ ID NO: 827425 - protein, 73 aa, Homo sapiens; identical to SEQ ID NO: 827413

SEQ ID NO: 827426 - protein, 73 aa, Homo sapiens; identical to SEQ ID NO: 827413

SEQ ID NO: 827427 - protein, 787 aa, Homo sapiens
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESETPEKKQSESSRGRKRKAENQNESSQGFPNLPVFQSLAYWEMGRTAGGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 827428 - protein, 787 aa, Homo sapiens; identical to SEQ ID NO: 827427

SEQ ID NO: 827429 - protein, 787 aa, Homo sapiens; identical to SEQ ID NO: 827427

SEQ ID NO: 827430 - protein, 766 aa, Homo sapiens
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESETPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 827431 - protein, 549 aa, Homo sapiens
MLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 827432 - protein, 766 aa, Homo sapiens; identical to SEQ ID NO: 827430

SEQ ID NO: 827433 - protein, 211 aa, Homo sapiens
MSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 827434 - protein, 766 aa, Homo sapiens; identical to SEQ ID NO: 827430

SEQ ID NO: 827435 - protein, 674 aa, Homo sapiens
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESETPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVGGISPDTTTWIKFQINVYNPIEPYIIKSFKV

SEQ ID NO: 827436 - protein, 445 aa, Homo sapiens
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESETPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQ

SEQ ID NO: 827437 - protein, 478 aa, Homo sapiens
SSAPPTYHAVKATPAPARTVSKLVLKSRPLFLGRPVDRASAAETMSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQALSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 827438 - protein, 467 aa, Homo sapiens
MSGGINRHEAKLVLKSRPLFLGRPVDRASAAETMSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQALSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 827439 - protein, 434 aa, Homo sapiens
MSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQALSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 827440 - protein, 478 aa, Homo sapiens; identical to SEQ ID NO: 827437

SEQ ID NO: 827441 - protein, 492 aa, Homo sapiens
SSAPPTYHAVKATPAPARTVSKLVLKSRPLFLGRPVDRASAAETMSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQALSLMETVKQGVDQKLVEGQEKLHQMWLSWNQKQLQGPEKEPPKPEQVESRALTMFRDIAQQLQATCTSLGSSIQAPTSEDRSQPRSGDSGSVRSLFRPVRRLAKAGGFPGPEGGTLGTCGRTLSGRDLARKLKPAKYGAGQCAQYEFGTSEDNLYTQCCNIIRRRYVGEKVEI

SEQ ID NO: 827442 - protein, 457 aa, Homo sapiens
EAGWWSRPLFLGRPVDRASAAETMSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQALSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 827443 - protein, 476 aa, Homo sapiens
MLRRTAYCRRAGIRAASVIDWQQEATSTSCDRVDTRLDLCSNTLGRTRCAGHIRVLDWSSVVEMCSSRCHGYACCICIIGCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQALSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 827444 - protein, 320 aa, Homo sapiens
EAGWWSRPLFLGRPVDRASAAETMSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELAESAHPWIGSTSSQCTEERGTRLLDVWPRGKVRNAEDLGVYHQRGRSCAVSLLRNQSYKLERKPMCDKLARAEAAMNKVRKLRTEV

SEQ ID NO: 827445 - protein, 478 aa, Homo sapiens; identical to SEQ ID NO: 827437

SEQ ID NO: 827446 - protein, 478 aa, Homo sapiens; identical to SEQ ID NO: 827437

SEQ ID NO: 827447 - protein, 414 aa, Homo sapiens
SSAPPTYHAVKATPAPARTVSKLVLKSRPLFLGRPVDRASAAETMSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQALSLMETVKQGVDQKLVEGQEKLHQMWLSWNQKQLQGPEKEPPKPEQVESRALTMFRDIAQQLQATCTSLGSSIQGLPTNVKIAPLHSSLGDKSET

SEQ ID NO: 827448 - protein, 436 aa, Homo sapiens
SSAPPTYHAVKATPAPARTVSKLVLKSRPLFLGRPVDRASAAETMSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 827449 - protein, 403 aa, Homo sapiens [sequence omitted]

SEQ ID NO: 827450 - protein, 271 aa, Homo sapiens
MSGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGKVTIAQGGVLPNIQAVLLPKKTESHHKAKAGFEKFAMARTKQTARKSTGGKAPRKQLATKAARKSAPATGGVKKPHRYRPGTVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 827451 - protein, 1588 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 827452 - protein, 1588 aa, Homo sapiens; identical to SEQ ID NO: 827451

SEQ ID NO: 827453 - protein, 1581 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQFLKLKKW

SEQ ID NO: 827454 - protein, 1545 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 827455 - protein, 1545 aa, Homo sapiens; identical to SEQ ID NO: 827454

SEQ ID NO: 827456 - protein, 1673 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRESLGIPSRWVTEGPHLSGPWARVNQKALRSLNALVVLPSPEDGVLIQGLRNYGKGVATVVSIIMAHTPKIRYPCLGIIGASVHSRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 827457 - protein, 1099 aa, Homo sapiens
MVHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 827458 - protein, 461 aa, Homo sapiens
MIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 827459 - protein, 229 aa, Homo sapiens
HEGPTCSLNVCVVSVPAWTDTKDISVVSVPACTTNVCFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 827460 - protein, 142 aa, Homo sapiens [sequence omitted]

SEQ ID NO: 827461 - protein, 142 aa, Homo sapiens [sequence omitted]

SEQ ID NO: 827462 - protein, 1652 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFGNYTILLLGLDSHGSNSNLGAPEEGLGAGRRRTSVEKSGGAGVTRKKRDPWMRAGMWKGKIDNGSQKSKWGLRWVSSLEVVLKQLSEVAPPPRAGPASGQKVWDTADWRPPSSTMSMSPAAISLAAQCASQPPWRRSGLHLASVPDKGAPGVAGRLT

SEQ ID NO: 827463 - protein, 904 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTMLAAACHSLCDCSGAANSLWPATPSASEDGVVEASGVPGTAGCSA

SEQ ID NO: 827464 - protein, 116 aa, Homo sapiens
RGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRYSLLLMPNGGSI

SEQ ID NO: 827465 - protein, 141 aa, Homo sapiens
MFFRHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPR

SEQ ID NO: 827466 - protein, 120 aa, Homo sapiens [sequence omitted]

SEQ ID NO: 827467 - protein, 444 aa, Homo sapiens
MSSSYDEASLAPEETTDSFWEVGNYKRTVKRIDDGHRLCNDLMNCVQERAKIEKAYGQQLTDWAKRWRQLIEKGPQYGSLERAWGAIMTEADKVSELHQEVKNNLLNEDLEKVKNWQKDAYHKQIMGGFKETKEAEDGFRKAQKPWAKKMKELEAAKKAYHLACKEEKLAMTREMNSKTEQSVTPEQQKKLQDKVDKCKQDVQKTQEKYEKVLEDVGKTTPQYMENMEQVFEQCQQFEEKRLVFLKEVLLDIKRHLNLAENSSYIHVYRELEQAIRGADAQEDLRWFRSTSGPGMPMNWPQFEEWNPDLPHTTTKKEKQPKKAEGVALTNATGAVESTSQAGDRGSVSSYDRGQPYATEWSDDESGNPFGGSETNGGANPFEDDSKGVRVRALYDYDGQEQDELSFKAGDELTKLGEEDEQGWCRGRLDSGQLGLYPANYVEAI

SEQ ID NO: 827468 - protein, 444 aa, Homo sapiens; identical to SEQ ID NO: 827467

SEQ ID NO: 827469 - protein, 444 aa, Homo sapiens; identical to SEQ ID NO: 827467

SEQ ID NO: 827470 - protein, 444 aa, Homo sapiens; identical to SEQ ID NO: 827467

SEQ ID NO: 827471 - protein, 295 aa, Homo sapiens
RRWRKHRVSGLLSGLGYRAIYTETRKLEKPSSYTRRSGSHRLATSLPFSPMAHVLQKPKHSGTHSIVQEFQVPDYVPWQQSKQETKPSTLPPVQQANSLHTSKMKTLTRVQPVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDEAG

SEQ ID NO: 827472 - protein, 310 aa, Homo sapiens
MKTLTRVQPVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREFIDQFEENMPVLRAEVEELQAQTREPREVIFEDVLLRRPKCTPDMDVILNIPVEEPLPF

SEQ ID NO: 827473 - protein, 297 aa, Homo sapiens
MKTLTRVQPVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAVSSQLLCGSGDPGLTPTPPSSPSSASRPTAAPSVSTMFCCPGRGTWGPDLFFLHRKPSVPMKRLSYRRCGKARTS

SEQ ID NO: 827474 - protein, 261 aa, Homo sapiens
MKTLTRVQPVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREVRGQGRWWSL

SEQ ID NO: 827475 - protein, 413 aa, Homo sapiens
RRWRKHRVSGLLSGLGYRAIYTETRKLEKPSSYTRRSGSHRLATSLPFSPMAHVLQKPKHSGTHSIVQEFQVPDYVPWQQSKQETKPSTLPPVQQANSLHTSKMKTLTRVQPVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREFIDQFEENMPVLRAEVEELQAQTREPREVIFEDVLLRRPKCTPDMDVILNIPVEEPLPF

SEQ ID NO: 827476 - protein, 350 aa, Homo sapiens
AGGDHCSRPQDYVPWQQSKQETKPSTLPPVQQANSLHTSKMKTLTRVQPVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREFIDQFEENMPVLRAEVEELQAQTREPREVIFEDVLLRRPKCTPDMDVILNIPVEEPLPF

SEQ ID NO: 827477 - protein, 472 aa, Homo sapiens
RRWRKHRVSGLLSGLGYRAIYTETRKLEKPSSYTRRSGSHRLATSLPFSPMAHVLQKPKHSGTHSIVQEFQVPDYVPWQQSKQETKPSTLPPVQQANSLHTSKMKTLTRVQPGRTTALRVFQRQPVGVLRGCCAFVWCCGPTSQVTRSKSNNWYCVSSTEYASGTIPNTFEVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREFIDQFEENMPVLRAEVEELQAQTREPREVIFEDVLLRRPKCTPDMDVILNIPVEEPLPF

SEQ ID NO: 827478 - protein, 361 aa, Homo sapiens
HSRGAIVPGKLQFLVRDSNPVSNCCLLPLGLGIMEVLSLPNSFQTQALWDSLHSPGVPGSVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREFIDQFEENMPVLRAEVEELQAQTREPREVIFEDVLLRRPKCTPDMDVILNIPVEEPLPF

SEQ ID NO: 827479 - protein, 312 aa, Homo sapiens
HSRGAIVPGKLQFLVRDSNPVSNCCLLPLGLGIMEVLSLPNSFQTQALWDSLHSPGVPGSVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREVRGQGRWWSL

SEQ ID NO: 827480 - protein, 312 aa, Homo sapiens
MGNRPAWAAFTSRRPHGGGRLAGPGRRVHGLSGAQAGQGAAPPLCSSLRPQTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREFIDQFEENMPVLRAEVEELQAQTREPREVIFEDVLLRRPKCTPDMDVILNIPVEEPLPF

SEQ ID NO: 827481 - protein, 299 aa, Homo sapiens
MGNRPAWAAFTSRRPHGGGRLAGPGRRVHGLSGAQAGQGAAPPLCSSLRPQTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAVSSQLLCGSGDPGLTPTPPSSPSSASRPTAAPSVSTMFCCPGRGTWGPDLFFLHRKPSVPMKRLSYRRCGKARTS

SEQ ID NO: 827482 - protein, 95 aa, Homo sapiens
HSRGAIVPGKLQFLVRDSNPVSNCCLLPLGLGIMEVLSLPNSFQTQALWDSLHSPGVPGSGLCSMAAVQAGNQAIYSASSPTSQQPSYKQNEDFD

SEQ ID NO: 827483 - protein, 144 aa, Homo sapiens
RRWRKHRVSGLLSGLGYRAIYTETRKLEKPSSYTRRSGSHRLATSLPFSPMAHVLQKPKHSGTHSIVQEFQVPDYVPWQQSKQETKPSTLPPVQQANSLHTSKMKTLTRVQPGGRRHLGAGVGVGDRIEWLLLALGDTTYIRVG

SEQ ID NO: 827484 - protein, 40 aa, Homo sapiens
MRRKVLESLSDKIQKKKKKILSSVVAVSSQLLCGSGDPGL

SEQ ID NO: 827485 - protein, 74 aa, Homo sapiens
TACYLVDCGSKSGRVGNPAQELQPRLGVVLPGRGPTEVRGEEDSGADSAHFTRSCSSDCEDSSLSWNPTDHQQK

SEQ ID NO: 827486 - protein, 1257 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEVDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSSKCTPVKHLNVSKPQKLARSPARISPHIKDGEKDKHREKHPNSSPRTYKWSFQLNELDNMNSTERISFLQEKLQEIRKYYMSLKSEVATIDRRRKRLKKKDREVSHAGASMSSASSDTGMSPSSSSPPQNVLAVECR

SEQ ID NO: 827487 - protein, 1257 aa, Homo sapiens; identical to SEQ ID NO: 827486

SEQ ID NO: 827488 - protein, 1188 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEVDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTDELDNMNSTERISFLQEKLQEIRKYYMSLKSEVATIDRRRKRLKKKDREVSHAGASMSSASSDTGMSPSSSSPPQNVLAVECR

SEQ ID NO: 827489 - protein, 1203 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEVDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSNELDNMNSTERISFLQEKLQEIRKYYMSLKSEVATIDRRRKRLKKKDREVSHAGASMSSASSDTGMSPSSSSPPQNVLAVECR

SEQ ID NO: 827490 - protein, 935 aa, Homo sapiens
MEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEVDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSSKCTPVKHLNVSKPQKLARSPARISPHIKDGEKDKHREKHPNSSPRTYKWSFQLNELDNMNSTERISFLQEKLQEIRKYYMSLKSEVATIDRRRKRLKKKDREVSHAGASMSSASSDTGMSPSSSSPPQNVLAVECR

SEQ ID NO: 827491 - protein, 688 aa, Homo sapiens
MEPCLTGTKVKVKYGRGKTQKIYEASIKSTEIDDGEVLYLVHYYGWNVRYDEWVKADRIIWPLDKGGPKKKQKKKAKNKEDSEVDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSSKCTPVKHLNVSKPQKLARSPARISPHIKDGEKDKHREKHPNSSPRTYKWSFQLNELDNMNSTERISFLQEKLQEIRKYYMSLKSEVATIDRRRKRLKKKDREVSHAGASMSSASSDTGMSPSSSSPPQNVLAVECR

SEQ ID NO: 827492 - protein, 127 aa, Homo sapiens
QHSLFPLISGQKRPSDGNSGLMAKKQKRTPKRTSAAAKNEKNGTDELDNMNSTERISFLQEKLQEIRKYYMSLKSEVATIDRRRKRLKKKDREVSHAGASMSSASSDTGMSPSSSSPPQNVLAVECR

SEQ ID NO: 827493 - protein, 1265 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKGPKTLKKKEKEKPPRGGGFKNPFFFEKRGDFLGFFGPPFPGGGTNVVFLIIGGGGTPPKIFFEAPLFKNPPEFCAAGKCFLFLGAPFSKGWELSRYDEWVKADRIIWPLDKGGPKKKQKKKAKNKEDSEVDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSSKCTPVKHLNVSKPQKLARSPARISPHIKDGEKDKHREKHPNSSPRTYKWSFQLNELDNMNSTERISFLQEKLQEIRKYYMSLKSEVATIDRRRKRLKKKDREVSHAGASMSSASSDTGMSPSSSSPPQNVLAVECR

SEQ ID NO: 827494 - protein, 579 aa, Homo sapiens [sequence omitted]

SEQ ID NO: 827495 - protein, 603 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQYHTIYLCDIPAPIP

SEQ ID NO: 827496 - protein, 185 aa, Homo sapiens
PLLSPQSGIGSRALWVLIGRGPLYSTQLALPSRKSAALCPSALGAFCVASRCACAVPPRPTRGLALRFPQTCSQHPAVFPVRPAARGASTMLFYSFFKSLVGKDVVVELKNDLSICGTLHSVDQYLNIKLTDISVTDPEKYPHMLSVKNCFIRGSVVRYVQLPADEVDTQLLQDAARKEALQQKQ

SEQ ID NO: 827497 - protein, 162 aa, Homo sapiens
PLLSPQSGIGSRALWVLIGRGLSTLPSLRSPAASRPRFARQRLELSASLPAAPARSRLAPRAGSRFGFPRPARSTLLSSRSGPLPAAPAPCICGTLHSVDQYLNIKLTDISVTDPEKYPHMLSVKNCFIRGSVVRYVQLPADEVDTQLLQDAARKEALQQKQ

SEQ ID NO: 827498 - protein, 178 aa, Homo sapiens
PLLSPQSGIGSRALWVLIGRGPLYSTQLALPSRKSAALCPSALGAFCVASRCACAVPPRPTRGLALRFPQTCSQHPAVFPVRPAARGASTMSLVGKDVVVELKNDLSICGTLHSVDQYLNIKLTDISVTDPEKYPHMLSVKNCFIRGSVVRYVQLPADEVDTQLLQDAARKEALQQKQ

SEQ ID NO: 827499 - protein, 847 aa, Homo sapiens
MEPLKSLFLKSPLGSWNGSGSGGGGGGGGGRPEGSPKAAGYANPVWTALFDYEPSGQDELALRKGDRVEVLSRDAAISGDEGWWAGQVGGQVGIFPSNYVSRGGGPPPCEVASFQELRLEEVIGIGGFGKVYRGSWRGELVAVKAARQDPDEDISVTAESVRQEARLFAMLAHPNIIALKAVCLEEPNLCLVMEYAAGGPLSRALAGRRVPPHVLVNWAVQIARGMHYLHCEALVPVIHRDLKSNNILLLQPIESDDMEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQLMADCWAQDPHRRPDFASILQQLEALEAQVLREMPRDSFHSMQEGWKREIQGLFDELRAKEKELLSREEELTRAAREQRSQAEQLRRREHLLAQWELEVFERELTLLLQQVDRERPHVRRRRGTFKRSKLRARDGGERISMPLDFKHRITVQASPGLDRRRNVFEVGPGDSPTFPRFRAIQLEPAEPGQAWGRQSPRRLEDSSNGERRACWAWGPSSPKPGEAQNGRRRSRMDEATWYLDSDDSSPLGSPSTPPALNGNPPRPSLEPEEPKRPVPAERGSSSGTPKLIQRALLRGTALLASLGLGRDLQPPGGPGRERGESPTTPPTPTPAPCPTEPPPSPLICFSLKTPDSPPTPAPLLLDLGIPVGQRSAKSPRREEEPRGGTVSPPPGTSRSAPGTPGTPRSPPLGLISRPRPSPLRSRIDPWSFVSAGPRPSPLPSPQPAPRRAPWTLFPDSDPFWDSPPANPFQGGPQDCRAQTKDMGAQAPWVPEAGP

SEQ ID NO: 827500 - protein, 67 aa, Homo sapiens
MEPLKSLFLKSPLGSWNGSGSGGGGGGGGGRPEGSPKAAGYANPVWTALFDYEPSGQGIEALGPPLF

SEQ ID NO: 827501 - protein, 847 aa, Homo sapiens; identical to SEQ ID NO: 827499

SEQ ID NO: 827502 - protein, 847 aa, Homo sapiens; identical to SEQ ID NO: 827499

SEQ ID NO: 827503 - protein, 847 aa, Homo sapiens; identical to SEQ ID NO: 827499

SEQ ID NO: 827504 - protein, 263 aa, Homo sapiens
MDEATWYLDSDDSSPLGSPSTPPALNGNPPRPSLEPEEPKRPVPAERGSSSGTPKLIQRALLRGTALLASLGLGRDLQPPGGPGRERGESPTTPPTPTPAPCPTEPPPSPLICFSLKTPDSPPTPAPLLLDLGIPVGQRSAKSPRREEEPRGGTVSPPPGTSRSAPGTPGTPRSPPLGLISRPRPSPLRSRIDPWSFVSAGPRPSPLPSPQPAPRRAPWTLFPDSDPFWDSPPANPFQGGPQDCRAQTKDMGAQAPWVPEAGP

SEQ ID NO: 827505 - protein, 539 aa, Homo sapiens
MEPLKSLFLKSPLGSWNGSGSGGGGGGGGGRPEGSPKAAGYANPVWTALFDYEPSGQDELALRKGDRVEVLSRDAAISGDEGWWAGQVGGQVGIFPSNYVSRGGGPPPCEVASFQELRLEEVIGIGGFGKVYRGSWRGELVAVKAARQDPDEDISVTAESVRQEARLFAMLAHPNIIALKAVCLEEPNLCLVMEYAAGGPLSRALAGRRVPPHVLVNWAVQIARGMHYLHCEALVPVIHRDLKSNNILLLQPIESDDMEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQLMADCWAQDPHRRPDFASILQQLEALEAQVLREMPRDSFHSMQEGWKREIQGLFDELRAKEKELLSREEELTRAAREQRSQAEQLRRREHLLAQWELEVFERELTLLLQQVDRERPHVRRRRGTFKRSKLRARDGGERISMPLDPGAQESSEAGHSLTAIVPLPMWPGSWPWAPAGWGPGSTSSQT

SEQ ID NO: 827506 - protein, 142 aa, Homo sapiens
VSQPSCRSLCGLGAGLGPLQVGVLALLHHKPEPCSPQPKSQTSSTASPCRPHPALTGGETSSRSGLGIRPPFPGSEPSSVRNFTSHAPLRPPAPYSLSDLILGGGNSLSPLPPRPQAPCLRSSLLPLNSPSSINFTYFFLVK

SEQ ID NO: 827507 - protein, 393 aa, Homo sapiens
MAQENAAFSPGQEEPPRRRGRQRYVEKDGRCNVQQGNVRETYRYLTDLFTTLVDLQWRLSLLFFVLAYALTWLFFGAIWWLIAYGRGDLEHLEDTAWTPCVNNLNGFVAAFLFSIETETTIGYGHRVITDQCPEGIVLLLLQAILGSMVNAFMVGCMFVKISQPNKRAATLVFSSHAVVSLRDGRLCLMFRVGDLRSSHIVEASIRAKLIRSRQTLEGEFIPLHQTDLSVGFDTGDDRLFLVSPLVISHEIDAASPFWEASRRALERDDFEIVVILEGMVEATGMTCQARSSYLVDEVLWGHRFTSVLTLEDGFYEVDYASFHETFEVPTPSCSARELAEAAARLDAHLYWSIPSRLDEKVEEEGVGEGAGGEAGADKEQNGCLPPPESESKV

SEQ ID NO: 827508 - protein, 342 aa, Homo sapiens [sequence omitted]

SEQ ID NO: 827509 - protein, 125 aa, Homo sapiens
VSFVCVSPLPFSLIFFSDVFLQGKRFHEALESILSPQETLKERDENLLKSGYIESVQHILKDVSGVRALESAVQHETLNYIGLLDCVAEYQLRQENHLTPGGRGCSEPISPTTLQPGRQRETPSK

SEQ ID NO: 827510 - protein, 173 aa, Homo sapiens [sequence omitted]

SEQ ID NO: 827511 - protein, 262 aa, Homo sapiens
MKLFQTICRQLRSSKFSVESAALVAFSTSSYSCGRKKKVNPYEEVDQEKYSNLVQSVLSSRGVAQTPGSVEEDALLCGPVSKHKLPNQDVFLQGKRFHEALESILSPQETLKERDENLLKSGYIESVQHILKDVSGVRALESAVQHETLNYIGLLDCVAEYQGKLCVIDWKTSEKPKPFIQSTFDNPLQVVAYMGAMNHDTNYSFQVQCGLIVVAYKDGSPAHPHFMDAELCSQYWTKWLLRLEEYTEKKKNQNIQKPEYSE

SEQ ID NO: 827512 - protein, 342 aa, Homo sapiens [sequence omitted]

SEQ ID NO: 827513 - protein, 342 aa, Homo sapiens [sequence omitted]

SEQ ID NO: 827514 - protein, 183 aa, Homo sapiens [sequence omitted]

SEQ ID NO: 827515 - protein, 342 aa, Homo sapiens [sequence omitted]

SEQ ID NO: 827516 - protein, 342 aa, Homo sapiens [sequence omitted]

SEQ ID NO: 827517 - protein, 299 aa, Homo sapiens
MWPEEKYSNLVQSVLSSRGVAQTPGSVEEDALLCGPVSKHKLPNQGEDRRVPQNWFPIFNPERSDKPNASDPSVPLKIPLQRNVIPSVTRVLQQTMTKQQVFLLERWKQRMILELGEDGFKEYTSNVFLQGKRFHEALESILSPQETLKERDENLLKSGYIESVQHILKDVSGVRALESAVQHETLNYIGLLDCVAEYQGKLCVIDWKTSEKPKPFIQSTFDNPLQVVAYMGAMNHDTNYSFQVQCGLIVVAYKDGSPAHPHFMDAELCSQYWTKWLLRLEEYTEKKKNQNIQKPEYSE

SEQ ID NO: 827518 - protein, 342 aa, Homo sapiens [sequence omitted]

SEQ ID NO: 827519 - protein, 352 aa, Homo sapiens
AELIVGSCRAVLPSCEGNGGEIKGNGSESAPAAAARPRRRHRDSEALCTPGRSPLCAAEPVLDATSPPSVFGAEIAKTEGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 827520 - protein, 281 aa, Homo sapiens
AELIVGSCRAVLPSCEGNGGEIKGNGSESAPAAAARPRRRHRDSEALCTPGRSPLCAAEPVLDATSPPSVFGAEIAKTEGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHKEKCGIEPVAGPDNEENNVRMNPPKEENPGLWGPGSDNLVRENKLRRGTQNTRQAQEYEKSHQLLVAR

SEQ ID NO: 827521 - protein, 352 aa, Homo sapiens; identical to SEQ ID NO: 827519

SEQ ID NO: 827522 - protein, 265 aa, Homo sapiens
MAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 827523 - protein, 352 aa, Homo sapiens; identical to SEQ ID NO: 827519

SEQ ID NO: 827524 - protein, 352 aa, Homo sapiens; identical to SEQ ID NO: 827519

SEQ ID NO: 827525 - protein, 295 aa, Homo sapiens
AELIVGSCRAVLPSCEGNGGEIKGNGSESAPAAAARPRRRHRDSEALCTPGRSPLCAAEPVLDATSPPSVFGAEIAKTEGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPNVIDTDFIDEEVLMSLVIEMGLDRIKELPELWLGQNEFDFMTDFVCKQQPSRVSC

SEQ ID NO: 827526 - protein, 265 aa, Homo sapiens; identical to SEQ ID NO: 827522

SEQ ID NO: 827527 - protein, 241 aa, Homo sapiens
MGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 827528 - protein, 166 aa, Homo sapiens
MAGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGRSLTLLPRLEYSGAILTHCSLDLLASSNPPASTSRVSGTTSAHHHAQLIFL

SEQ ID NO: 827529 - protein, 216 aa, Homo sapiens
LFRLWAKALSGDHSVSLGDTPSLGPDLVPTGVPSPPPRCGTHIPNAGRGRAQQARPRRAARLGSSPGAAAGRAGGRGDGVAAAARVGPGDPVHVCKRSRTPRPTRAARAPRCVRATLLAAPMAFRGWRPPPPPLLLLLLWVTGQAAPVAGLGSDAELQIERRFVPDECPRTVRSGDFVRYHYVGTFPDGQKFDSRYRALGARRGLSGCASLSPDRP

SEQ ID NO: 827530 - protein, 338 aa, Homo sapiens
MAGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 827531 - protein, 691 aa, Homo sapiens
LFRLWAKALSGDHSVSLGDTPSLGPDLVPTGVPSPPPRCGTHIPNAGRGRAQQARPRRAARLGSSPGAAAGRAGGRGDGVAAAARVGPGDPVHVCKRSRTPRPTRAARAPRCVRATLLAAPMAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 827532 - protein, 691 aa, Homo sapiens; identical to SEQ ID NO: 827531

SEQ ID NO: 827533 - protein, 691 aa, Homo sapiens; identical to SEQ ID NO: 827531

SEQ ID NO: 827534 - protein, 691 aa, Homo sapiens; identical to SEQ ID NO: 827531

SEQ ID NO: 827535 - protein, 678 aa, Homo sapiens
LFRLWAKALSGDHSVSLGDTPSLGPDLVPTGVPSPPPRCGTHIPNAGRGRAQQARPRRAARLGSSPGAAAGRAGGRGDGVAAAARVGPGDPVHVCKRSRTPRPTRAARAPRCVRATLLAAPMAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKFCPNR

SEQ ID NO: 827536 - protein, 693 aa, Homo sapiens
LFRLWAKALSGDHSVSLGDTPSLGPDLVPTGVPSPPPRCGTHIPNAGRGRAQQARPRRAARLGSSPGAAAGRAGGRGDGVAAAARVGPGDPVHVCKRSRTPRPTRAARAPRCVRATLLAAPMAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFPNGGGTYPEVVNDFPLKLLYFTNLNYFVLM

SEQ ID NO: 827537 - protein, 498 aa, Homo sapiens
LFRLWAKALSGDHSVSLGDTPSLGPDLVPTGVPSPPPRCGTHIPNAGRGRAQQARPRRAARLGSSPGAAAGRAGGRGDGVAAAARVGPGDPVHVCKRSRTPRPTRAARAPRCVRATLLAAPMAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGEHQHHLPSSLAVAASTLLETGLLFLFLLSF

SEQ ID NO: 827538 - protein, 519 aa, Homo sapiens
LFRLWAKALSGDHSVSLGDTPSLGPDLVPTGVPSPPPRCGTHIPNAGRGRAQQARPRRAARLGSSPGAAAGRAGGRGDGVAAAARVGPGDPVHVCKRSRTPRPTRAARAPRCVRATLLAAPMAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGRSLTLLPRLEYSGAILTHCSLDLLASSNPPASTSRVSGTTSAHHHAQLIFL

SEQ ID NO: 827539 - protein, 67 aa, Homo sapiens
TGKQAYDPMNDPSLEINPLTYKGNKKPGLPTAVAARLLEPSGSPRACQEFGTEIFLLPICVLETVVP

SEQ ID NO: 827540 - protein, 691 aa, Homo sapiens; identical to SEQ ID NO: 827531

SEQ ID NO: 827541 - protein, 639 aa, Homo sapiens
LFRLWAKALSGDHSVSLGDTPSLGPDLVPTGVPSPPPRCGTHIPNAGRGRAQQARPRRAARLGSSPGAAAGRAGGRGDGVAAAARVGPGDPVHVCKRSRTPRPTRAARAPRCVRATLLAAPMAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEVTNWPL

SEQ ID NO: 827542 - protein, 691 aa, Homo sapiens; identical to SEQ ID NO: 827531

SEQ ID NO: 827543 - protein, 691 aa, Homo sapiens; identical to SEQ ID NO: 827531

SEQ ID NO: 827544 - protein, 691 aa, Homo sapiens; identical to SEQ ID NO: 827531

SEQ ID NO: 827545 - protein, 605 aa, Homo sapiens
LFRLWAKALSGDHSVSLGDTPSLGPDLVPTGVPSPPPRCGTHIPNAGRGRAQQARPRRAARLGSSPGAAAGRAGGRGDGVAAAARVGPGDPVHVCKRSRTPRPTRAARAPRCVRATLLAAPMAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIDCRKTAMTVHLPT

SEQ ID NO: 827546 - protein, 480 aa, Homo sapiens
LFRLWAKALSGDHSVSLGDTPSLGPDLVPTGVPSPPPRCGTHIPNAGRGRAQQARPRRAARLGSSPGAAAGRAGGRGDGVAAAARVGPGDPVHVCKRSRTPRPTRAARAPRCVRATLLAAPMAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGGETPSIHPSKIY

SEQ ID NO: 827547 - protein, 423 aa, Homo sapiens
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQVRQRLGSL

SEQ ID NO: 827548 - protein, 417 aa, Homo sapiens
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 827549 - protein, 417 aa, Homo sapiens; identical to SEQ ID NO: 827548

SEQ ID NO: 827550 - protein, 417 aa, Homo sapiens; identical to SEQ ID NO: 827548

SEQ ID NO: 827551 - protein, 87 aa, Homo sapiens
GEGLRPQARRAGLLPSFLLLSRGVCPGPEQSVQFRNSIGGSSWSPTTLKIIRSGALRASPRGGKLSSESSASGFEIYILRQCRKSVF

SEQ ID NO: 827552 - protein, 103 aa, Homo sapiens
MALPADARSGRSTPCVGAEGTRWVRPGRGWARAWRPPGARLPGALPFGERSQGTAPTSLHKPGTLRPTAAGELRPGAPSPTTPGSLPGSPSRDCAFCNRAVLQ

SEQ ID NO: 827553 - protein, 154 aa, Homo sapiens
MASHRHSGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGTASFPPRVPREEALRADVMWACLSWWG

SEQ ID NO: 827554 - protein, 280 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 827555 - protein, 280 aa, Homo sapiens; identical to SEQ ID NO: 827554

SEQ ID NO: 827556 - protein, 280 aa, Homo sapiens; identical to SEQ ID NO: 827554

SEQ ID NO: 827557 - protein, 296 aa, Homo sapiens
MASHRHSGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 827558 - protein, 323 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGKRTVSRVSHPVSKARKPPVCHGKRLPLTLFPSANLRGRHPGGERTCPSWVVVLYRKNRSLAAPRGPGLVKAPVWWPMKDNPGTTTASTAKNAP

SEQ ID NO: 827559 - protein, 105 aa, Homo sapiens
MASHRHSGPSSYKVGTMAEKFDCHYCRDPWPMRPLWPRTTRSCATSAPLGRTPPSARGASRPLWQEIKTWSTRGPSGTKTASPVVTASKSSGLEASSLKGRTSTA

SEQ ID NO: 827560 - protein, 230 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITG

SEQ ID NO: 827561 - protein, 194 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKGLVKAPVWWPMKDNPGTTTASTAKNAP

SEQ ID NO: 827562 - protein, 78 aa, Homo sapiens
DQRIPTASTGYKNFVAKKCAGCKNPITGFGKGSSVVAYEGQSWHDYCFHCKKCSVNLANKRFVFHQEQVYCPDCAKKL

SEQ ID NO: 827563 - protein, 280 aa, Homo sapiens; identical to SEQ ID NO: 827554

SEQ ID NO: 827564 - protein, 117 aa, Homo sapiens
PYSVQHLIPPSNISSLLPTSHLSLQHLIAFQHLISFQHLISFQHLMAPSNISYSFQHLIAFQHLISFQHLITPSNISSLLPTSHDPFQHLIPVAAAAPTHCSPSSVSRKRTLLTCMV

SEQ ID NO: 827565 - protein, 280 aa, Homo sapiens; identical to SEQ ID NO: 827554

SEQ ID NO: 827566 - protein, 280 aa, Homo sapiens; identical to SEQ ID NO: 827554

SEQ ID NO: 827567 - protein, 149 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGTASFPPRVPREEALRADVMWACLSWWGCHQHGYDISQQ

SEQ ID NO: 827568 - protein, 138 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGTASFPPRVPREEALRADVMWACLSWWG

SEQ ID NO: 827569 - protein, 67 aa, Homo sapiens
RALHPPPGGGGSVRSRRRHRRASASVQAAAAAAETAARASIPTQHLGSCFQPYPAFAEYILSATHPA

SEQ ID NO: 827570 - protein, 280 aa, Homo sapiens; identical to SEQ ID NO: 827554

SEQ ID NO: 827571 - protein, 280 aa, Homo sapiens; identical to SEQ ID NO: 827554

SEQ ID NO: 827572 - protein, 280 aa, Homo sapiens; identical to SEQ ID NO: 827554

SEQ ID NO: 827573 - protein, 280 aa, Homo sapiens; identical to SEQ ID NO: 827554

SEQ ID NO: 827574 - protein, 280 aa, Homo sapiens; identical to SEQ ID NO: 827554

SEQ ID NO: 827575 - protein, 320 aa, Homo sapiens
RALHPPPGGGGSVRSRRRHRRASASVQAAAAAAETAARASIPTQHLGSCFQPYPAFAEYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 827576 - protein, 244 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDFPLQKMLRESGQQALCFPPGASVLSRLCQKAVN

SEQ ID NO: 827577 - protein, 280 aa, Homo sapiens; identical to SEQ ID NO: 827554

SEQ ID NO: 827578 - protein, 67 aa, Homo sapiens; identical to SEQ ID NO: 827569

SEQ ID NO: 827579 - protein, 218 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAATAAPRPRCRQRPPPLKTAARASIPTQHLGSCFQPYPAFAEYILSATHPA

SEQ ID NO: 827580 - protein, 280 aa, Homo sapiens; identical to SEQ ID NO: 827554

SEQ ID NO: 827581 - protein, 230 aa, Homo sapiens; identical to SEQ ID NO: 827560

SEQ ID NO: 827582 - protein, 136 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGRSKLGLIASHAVEVLPFTGRSFQSR

SEQ ID NO: 827583 - protein, 149 aa, Homo sapiens [sequence omitted]

SEQ ID NO: 827584 - protein, 253 aa, Homo sapiens
AKFLLREEAAAPRARRLGEQKRVGGAGGLGLSPGARGPGVVTLLAEEGRRPDARSGAAFPPTPAPGHAPCPVPRPAPLPVRREMPSTFLLSLQPLDCQMRLCASWADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 827585 - protein, 149 aa, Homo sapiens [sequence omitted]

SEQ ID NO: 827586 - protein, 149 aa, Homo sapiens [sequence omitted]

SEQ ID NO: 827587 - protein, 149 aa, Homo sapiens [sequence omitted]

SEQ ID NO: 827588 - protein, 149 aa, Homo sapiens [sequence omitted]

SEQ ID NO: 827589 - protein, 149 aa, Homo sapiens [sequence omitted]

SEQ ID NO: 827590 - protein, 149 aa, Homo sapiens [sequence omitted]

SEQ ID NO: 827591 - protein, 149 aa, Homo sapiens [sequence omitted]

SEQ ID NO: 827592 - protein, 113 aa, Homo sapiens; identical to SEQ ID NO: 766393

SEQ ID NO: 827593 - protein, 149 aa, Homo sapiens [sequence omitted]

SEQ ID NO: 827594 - protein, 149 aa, Homo sapiens [sequence omitted]

SEQ ID NO: 827595 - protein, 109 aa, Homo sapiens
MKWYDYKRIVLLSPGVTCCLSRERHHSHSGVTMARKMKDTDSEEEIREAFRVFDKDGNGYISAAELRHVMTNLGEKLTDEEVDEMIREADIDGDGQVNYEEFVQMMTAK

SEQ ID NO: 827596 - protein, 149 aa, Homo sapiens [sequence omitted]

SEQ ID NO: 827597 - protein, 149 aa, Homo sapiens [sequence omitted]

SEQ ID NO: 827598 - protein, 149 aa, Homo sapiens [sequence omitted]

SEQ ID NO: 827599 - protein, 149 aa, Homo sapiens [sequence omitted]

SEQ ID NO: 827600 - protein, 149 aa, Homo sapiens [sequence omitted]

SEQ ID NO: 827601 - protein, 149 aa, Homo sapiens [sequence omitted]

SEQ ID NO: 827602 - protein, 149 aa, Homo sapiens [sequence omitted]

SEQ ID NO: 827603 - protein, 149 aa, Homo sapiens [sequence omitted]

SEQ ID NO: 827604 - protein, 149 aa, Homo sapiens [sequence omitted]

SEQ ID NO: 827605 - protein, 66 aa, Homo sapiens
TRARSRTPGSGLHEFGTFLLPVFLAFCSLLDFLPEGWVRAVEGRHRPCASATGPWAGWLVEEMLTL

SEQ ID NO: 827606 - protein, 149 aa, Homo sapiens [sequence omitted]

SEQ ID NO: 827607 - protein, 149 aa, Homo sapiens [sequence omitted]

SEQ ID NO: 827608 - protein, 115 aa, Homo sapiens
MADQLTEEQIAEFKEAFSLFDKDGDGTITTKELGTVMRSLGQNPTEAELQDMINEVDADGNGTIDLPGLMPFSCLSLPRCWDYRREPLGPACIFYQPQIQQQAEDSAHKTGLVSW

SEQ ID NO: 827609 - protein, 78 aa, Homo sapiens
MAIISENLPVGQRAKVFSLRYTLTNVGYATGPMLGVVIAGQMPLAPFLIASAIAFGSLFLMIGIPPTQRDDSNKPLSF

SEQ ID NO: 827610 - protein, 149 aa, Homo sapiens [sequence omitted]

SEQ ID NO: 827611 - protein, 149 aa, Homo sapiens [sequence omitted]

SEQ ID NO: 827612 - protein, 149 aa, Homo sapiens [sequence omitted]

SEQ ID NO: 827613 - protein, 149 aa, Homo sapiens [sequence omitted]

SEQ ID NO: 827614 - protein, 149 aa, Homo sapiens [sequence omitted]

SEQ ID NO: 827615 - protein, 149 aa, Homo sapiens [sequence omitted]

SEQ ID NO: 827616 - protein, 253 aa, Homo sapiens; identical to SEQ ID NO: 827584

SEQ ID NO: 827617 - protein, 177 aa, Homo sapiens
QAVEEIRLSLRQCALGSADAVHSVHGRRLADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 827618 - protein, 302 aa, Homo sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQTLGLRPGHAGHYFLATQGPSFAERFCPLSSGYRFTR

SEQ ID NO: 827619 - protein, 317 aa, Homo sapiens
RTRCVTQREAKMASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 827620 - protein, 340 aa, Homo sapiens
LTYYTGPFYVSATRHLSDGRTLPEPPYVPRAEAKMASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 827621 - protein, 318 aa, Homo sapiens
IAVWNSDDSRAKMASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 827622 - protein, 318 aa, Homo sapiens; identical to SEQ ID NO: 827621

SEQ ID NO: 827623 - protein, 266 aa, Homo sapiens [sequence omitted]

SEQ ID NO: 827624 - protein, 294 aa, Homo sapiens
IAVWNSDDSRAKMASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEDRLGLKEMDNAGQLVFLATEGDHLQLSEEWFYAHIIPFLG

SEQ ID NO: 827625 - protein, 186 aa, Homo sapiens
RTRCVTQREAKMASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRTSCKPNTGMTP

SEQ ID NO: 827626 - protein, 318 aa, Homo sapiens; identical to SEQ ID NO: 827621

SEQ ID NO: 827627 - protein, 306 aa, Homo sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 827628 - protein, 318 aa, Homo sapiens; identical to SEQ ID NO: 827621

SEQ ID NO: 827629 - protein, 318 aa, Homo sapiens; identical to SEQ ID NO: 827621

SEQ ID NO: 827630 - protein, 297 aa, Homo sapiens
MGPWQLHSGSMTALHLWNLARDSRALVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 827631 - protein, 318 aa, Homo sapiens; identical to SEQ ID NO: 827621

SEQ ID NO: 827632 - protein, 268 aa, Homo sapiens
IAVWNSDDSRAKMASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFHRSGSRARLG

SEQ ID NO: 827633 - protein, 330 aa, Homo sapiens
MKIPSLLFGCMLSQNCFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPFLTQWVIYAIRNLTEDNSQNQDLIAKMEEQGLADASLLKKVGFEVEKKGEKLILKSTRDTPKP

SEQ ID NO: 827634 - protein, 330 aa, Homo sapiens; identical to SEQ ID NO: 827633

SEQ ID NO: 827635 - protein, 330 aa, Homo sapiens; identical to SEQ ID NO: 827633

SEQ ID NO: 827636 - protein, 330 aa, Homo sapiens; identical to SEQ ID NO: 827633

SEQ ID NO: 827637 - protein, 330 aa, Homo sapiens; identical to SEQ ID NO: 827633

SEQ ID NO: 827638 - protein, 327 aa, Homo sapiens
MKIPSLLFGCMLSQNCFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPCILACELPCTSLQPGPLAKQVPCLMFIHATIQSTLASLLALNFGSDFLTHLSVSAPAGSR

SEQ ID NO: 827639 - protein, 198 aa, Homo sapiens
MKIPSLLFGCMLSQNCFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLIAVIHVT

SEQ ID NO: 827640 - protein, 245 aa, Homo sapiens
PDQHANGLINQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPFLTQWVIYAIRNLTEDNSQNQDLIAKMEEQGLADASLLKKVGFEVEKKGEKLILKSTRDTPKP

SEQ ID NO: 827641 - protein, 108 aa, Homo sapiens
MAAPRPPPARLSGVMVPAPIQDLEALRALTALFKEQRNRETAPRTIFQRVLDILKKSSHAVELACRDPSQVENLASSLQLITECFRSERAAEPINSTQDYLPKMFWIS

SEQ ID NO: 827642 - protein, 330 aa, Homo sapiens; identical to SEQ ID NO: 827633

SEQ ID NO: 827643 - protein, 330 aa, Homo sapiens; identical to SEQ ID NO: 827633

SEQ ID NO: 827644 - protein, 330 aa, Homo sapiens; identical to SEQ ID NO: 827633

SEQ ID NO: 827645 - protein, 258 aa, Homo sapiens
MKIPSLLFGCMLSQNCFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELVVDEQIDE

SEQ ID NO: 827646 - protein, 282 aa, Homo sapiens
HRCLPKTILNQNAYQKHSDSGWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPFLTQWVIYAIRNLTEDNSQNQDLIAKMEEQGLADASLLKKVGFEVEKKGEKLILKSTRDTPKP

SEQ ID NO: 827647 - protein, 185 aa, Homo sapiens
MAAPRPPPARLSGVMVPAPIQDLEALRALTALFKEQRNRETAPRTIFQRVLDILKKSSHAVELACRDPSQVENLASSLQLITECFRCLRNACIECSVNQNSIRNLDTIGVAVDLILLFRELRVEQESLLTAFRCGLQFLGNIASRNEDSQSIVWVHAFPELFFVLLKSSGQKNCCLLFNDFVYIP

SEQ ID NO: 827648 - protein, 635 aa, Homo sapiens
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQGQALEQAIISQKPQLEKLIATTAHEKMPWFHGKISREESEQIVLIGSKTNGKFLIRARDNNGSYALCLLHEGKVLHYRIDKDKTGKLSIPEGKKFDTLWQLVEHYSYKADGLLRVLTVPCQKIGTQGNVNFGGRPQLPGSHPATWSAGGIISRIKSYSFPKPGHRKSSPAQGNRQESTVSFNPYEPELAPWAADKGPQREALPMDTEVYESPYADPEEIRPKEVYLDRKLLTLEDKELGSGNFGTVKKGYYQMKKVVKTVAVKILKNEANDPALKDELLAEANVMQQLDNPYIVRMIGICEAESWMLVMEMAELGPLNKYLQQNRHVKDKNIIELVHQVSMGMKYLEESNFVHRDLAARNVLLVTQHYAKISDFGLSKALRADENYYKAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 827649 - protein, 612 aa, Homo sapiens
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQGQALEQAIISQKPQLEKLIATTAHEKMPWFHGKISREESEQIVLIGSKTNGKFLIRARDNNGSYALCLLHEGKVLHYRIDKDKTGKLSIPEGKKFDTLWQLVEHYSYKADGLLRVLTVPCQKIGTQGNVNFGGRPQLPGSHPASSPAQGNRQESTVSFNPYEPELAPWAADKGPQREALPMDTEVYESPYADPEEIRPKEVYLDRKLLTLEDKELGSGNFGTVKKGYYQMKKVVKTVAVKILKNEANDPALKDELLAEANVMQQLDNPYIVRMIGICEAESWMLVMEMAELGPLNKYLQQNRHVKDKNIIELVHQVSMGMKYLEESNFVHRDLAARNVLLVTQHYAKISDFGLSKALRADENYYKAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 827650 - protein, 635 aa, Homo sapiens; identical to SEQ ID NO: 827648

SEQ ID NO: 827651 - protein, 635 aa, Homo sapiens; identical to SEQ ID NO: 827648

SEQ ID NO: 827652 - protein, 635 aa, Homo sapiens; identical to SEQ ID NO: 827648

SEQ ID NO: 827653 - protein, 635 aa, Homo sapiens; identical to SEQ ID NO: 827648

SEQ ID NO: 827654 - protein, 635 aa, Homo sapiens; identical to SEQ ID NO: 827648

SEQ ID NO: 827655 - protein, 635 aa, Homo sapiens; identical to SEQ ID NO: 827648

SEQ ID NO: 827656 - protein, 135 aa, Homo sapiens
CWDYRHEPMCPAHNFILNGISPSALLLAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 827657 - protein, 635 aa, Homo sapiens; identical to SEQ ID NO: 827648

SEQ ID NO: 827658 - protein, 635 aa, Homo sapiens; identical to SEQ ID NO: 827648

SEQ ID NO: 827659 - protein, 635 aa, Homo sapiens; identical to SEQ ID NO: 827648

SEQ ID NO: 827660 - protein, 635 aa, Homo sapiens; identical to SEQ ID NO: 827648

SEQ ID NO: 827661 - protein, 612 aa, Homo sapiens; identical to SEQ ID NO: 827649

SEQ ID NO: 827662 - protein, 193 aa, Homo sapiens [sequence omitted]

SEQ ID NO: 827663 - protein, 325 aa, Homo sapiens
MLLFLSVPQPRPPGARTRAGAARVARWRRLRLQQLRRLRGLLRVLRGRPGAGSRRRGRMALCGQAAGAASLPSELIVHIFSFLPAPDRLRASASCSHWRECLFYPALWPQLRICLRVSPAEQPRLEFLMRKCGWFVRELRVEFAAENYLSGGGPGDGGGADTGTGGEEVEALQLSARWLEVLRTYLELVLCVLVSIRNNRNLQKFSLFGDISVLQQQGSLSNTYLSKVDPDGKKKQLKWLSCGFMLEIVTPTSLSSLSNAVANTMEHLSLLDNNIPGNSTLITAVELERFVNLHSLALDFCDFTAEMARVLTDSNHVPLQRLSLL

SEQ ID NO: 827664 - protein, 217 aa, Homo sapiens [sequence omitted]

SEQ ID NO: 827665 - protein, 99 aa, Homo sapiens
TVLSFVYFSGYTVWAHNLIAIARLRGSDLKVLEVTEESIDFDQGELADQDVDPVHNLIEQVSLGLGQPWHAVMDIESLSVFTEPNRHFYREMQSFSEDI

SEQ ID NO: 827666 - protein, 243 aa, Homo sapiens
MLLFLSVPQPRPPGARTRAGAARVARWRRLRLQQLRRLRGLLRVLRGRPGAGSRRRGRMALCGQAAGAASLPSELIVHIFSFLPAPDRLRASASCSHWRECLFYPALWPQLRICLRVSPAEQPRLEFLMRKCGWFVRELRVEFAAENYLSGGGPGDGGGADTGTGGEEVEALQLSARWLEVLRTYLELVLCVLVSIRNNRNLQKFSLFGDISVLQQQGSLSNTYLSKVDPDGKKKFSNCLKKS

SEQ ID NO: 827667 - protein, 217 aa, Homo sapiens [sequence omitted]

SEQ ID NO: 827668 - protein, 160 aa, Homo sapiens
RIHFDSYITCVSGAIVDLISRQYDKFLTHFILMNDVIDTSGFPDLSDNRNEDPLVLLAWRCTKLSLLAIHGYTVWAHNLIAIARLRGSDLKVLEVTEESIDFDQGELADQDVDPVHNLIEQVSLGLGQPWHAVMDIESLSVFTEPNRHFYREMQSFSEDI

SEQ ID NO: 827669 - protein, 217 aa, Homo sapiens [sequence omitted]

SEQ ID NO: 827670 - protein, 1369 aa, Homo sapiens
AWLGLGFRGSAVLGVCWQLRSPPSRAARMMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 827671 - protein, 1254 aa, Homo sapiens
MLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 827672 - protein, 1093 aa, Homo sapiens
MSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 827673 - protein, 1348 aa, Homo sapiens
AWLGLGFRGSAVLGVCWQLRSPPSRAARMMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 827674 - protein, 1348 aa, Homo sapiens; identical to SEQ ID NO: 827673

SEQ ID NO: 827675 - protein, 1369 aa, Homo sapiens; identical to SEQ ID NO: 827670

SEQ ID NO: 827676 - protein, 892 aa, Homo sapiens
AWLGLGFRGSAVLGVCWQLRSPPSRAARMMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEKTLESNLFDDNIDIFADLTVKPKEKSKKKVEAKSIFDDDMDDIFSSGIQAKTTKPKSRSAQAAPEPRFFETPKSFVFSTTMLSEHILLSQIVLFILSQGALDLQLVEIAFSPSRNLCLGFKNESVMAMSY

SEQ ID NO: 827677 - protein, 276 aa, Homo sapiens
AWLGLGFRGSAVLGVCWQLRSPPSRAARMMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEVRAVWYDQVTVGSKLNLRWA

SEQ ID NO: 827678 - protein, 1338 aa, Homo sapiens
AWLGLGFRGSAVLGVCWQLRSPPSRAARMMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 827679 - protein, 972 aa, Homo sapiens
AVTLDDPVSLSAPRIGKLEPLFKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 827680 - protein, 1369 aa, Homo sapiens; identical to SEQ ID NO: 827670

SEQ ID NO: 827681 - protein, 848 aa, Homo sapiens
AWLGLGFRGSAVLGVCWQLRSPPSRAARMMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 827682 - protein, 344 aa, Homo sapiens
AWLGLGFRGSAVLGVCWQLRSPPSRAARMMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTSEPQPR

SEQ ID NO: 827683 - protein, 114 aa, Homo sapiens
AWLGLGFRGSAVLGVCWQLRSPPSRAARMMNRTTPDQELAPASEPVWERPWSVEEIRRSSQSWSLAADAGVRGGPRGRESGRGDAWLARRRAGPRLPLHLARPVACPLRNTRPV

SEQ ID NO: 827684 - protein, 339 aa, Homo sapiens
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 827685 - protein, 407 aa, Homo sapiens
LAARTCTRASAAPKPRSPPARLSRPHLRGLLLHDVTMAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 827686 - protein, 339 aa, Homo sapiens; identical to SEQ ID NO: 827684

SEQ ID NO: 827687 - protein, 352 aa, Homo sapiens
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYIAYLKDRRLSGGAVPSASMTRLARSRTASLTSASSVDGSRPQACTHSESSEGLGQVNHTMEVSC

SEQ ID NO: 827688 - protein, 341 aa, Homo sapiens
MLNQFRPFLLEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSAEKTRALNRARNGANGQNSEVPEKRGRGQVATLEERRGDKPKEPAKTLQRTKPKETHKRHNAQQREETHTNMHGGNTQNPKRKRQNTERYRRAQTRGTSRQSYTNRRRENTHSAKHSNNYHPQRADTSRSK

SEQ ID NO: 827689 - protein, 430 aa, Homo sapiens
LGFALSCRSAPGLPRSSPRLGRARCPDAATQSRAAPGAEMKVLGHRLELLTGLLLHDVTMAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 827690 - protein, 339 aa, Homo sapiens; identical to SEQ ID NO: 827684

SEQ ID NO: 827691 - protein, 438 aa, Homo sapiens
LAARTCTRASAAPKPRSPPARLSRPHLRGLLLHDVTMAGLQELRFPEEKPLLRGQDATELESSDAFLLAADTDWKAYTGTRLRHLIPQRSQERRLPRVSSTVSPLQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 827692 - protein, 408 aa, Homo sapiens
RLGTRPGWYHSSCPRPLDPSDSGLCLSFLVEAGSLPRQDAGVLGWGLTGTRLRHLIPQRSQERRLPRVSSTVSPLQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 827693 - protein, 425 aa, Homo sapiens
LAARTCTRASAAPKPRSPPARLSRPHLRGLLLHDVTMAGLQELRFPEEKPLLRGQDATELESSDAFLLAADTDWKRSQERRLPRVSSTVSPLQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 827694 - protein, 369 aa, Homo sapiens
MPECWDGVGEGNAGAVKLAGLGDPRWSPGHLLSPGHQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 827695 - protein, 352 aa, Homo sapiens; identical to SEQ ID NO: 827687

SEQ ID NO: 827696 - protein, 339 aa, Homo sapiens; identical to SEQ ID NO: 827684

SEQ ID NO: 827697 - protein, 339 aa, Homo sapiens; identical to SEQ ID NO: 827684

SEQ ID NO: 827698 - protein, 339 aa, Homo sapiens; identical to SEQ ID NO: 827684

SEQ ID NO: 827699 - protein, 339 aa, Homo sapiens; identical to SEQ ID NO: 827684

SEQ ID NO: 827700 - protein, 83 aa, Homo sapiens
SWYPPYRSGELAYAVEEWPGFWQGPDRHSLTWSHSEVQCSHDRTGTVKEPCVFTHLPKCSQGLAPIEHSSTVLVTCPKRSGRV

SEQ ID NO: 827701 - protein, 207 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIPYFETSAKEAINVEQAFQTIARNALKQETEVELYNEFPEPIKLDKNDRAKASAESCSC

SEQ ID NO: 827702 - protein, 207 aa, Homo sapiens; identical to SEQ ID NO: 827701

SEQ ID NO: 827703 - protein, 207 aa, Homo sapiens; identical to SEQ ID NO: 827701

SEQ ID NO: 827704 - protein, 207 aa, Homo sapiens; identical to SEQ ID NO: 827701

SEQ ID NO: 827705 - protein, 207 aa, Homo sapiens; identical to SEQ ID NO: 827701

SEQ ID NO: 827706 - protein, 132 aa, Homo sapiens
GSTRNVSAVRVEHRVLHKPRTHVGLQHNSPLLFQTKHTLISHIQLPKENPIKHSYTPHISHTHTHTHTHTHRSDVIKLQPLPVMAPWGLPAHPHEPASMAAGQASGGSHSDMELALEAYSFCSLERERTVYS

SEQ ID NO: 827707 - protein, 207 aa, Homo sapiens; identical to SEQ ID NO: 827701

SEQ ID NO: 827708 - protein, 207 aa, Homo sapiens; identical to SEQ ID NO: 827701

SEQ ID NO: 827709 - protein, 207 aa, Homo sapiens; identical to SEQ ID NO: 827701

SEQ ID NO: 827710 - protein, 207 aa, Homo sapiens; identical to SEQ ID NO: 827701

SEQ ID NO: 827711 - protein, 207 aa, Homo sapiens; identical to SEQ ID NO: 827701

SEQ ID NO: 827712 - protein, 207 aa, Homo sapiens; identical to SEQ ID NO: 827701

SEQ ID NO: 827713 - protein, 207 aa, Homo sapiens; identical to SEQ ID NO: 827701

SEQ ID NO: 827714 - protein, 207 aa, Homo sapiens; identical to SEQ ID NO: 827701

SEQ ID NO: 827715 - protein, 207 aa, Homo sapiens; identical to SEQ ID NO: 827701

SEQ ID NO: 827716 - protein, 207 aa, Homo sapiens; identical to SEQ ID NO: 827701

SEQ ID NO: 827717 - protein, 207 aa, Homo sapiens; identical to SEQ ID NO: 827701

SEQ ID NO: 827718 - protein, 207 aa, Homo sapiens; identical to SEQ ID NO: 827701

SEQ ID NO: 827719 - protein, 207 aa, Homo sapiens; identical to SEQ ID NO: 827701

SEQ ID NO: 827720 - protein, 207 aa, Homo sapiens; identical to SEQ ID NO: 827701

SEQ ID NO: 827721 - protein, 207 aa, Homo sapiens; identical to SEQ ID NO: 827701

SEQ ID NO: 827722 - protein, 207 aa, Homo sapiens; identical to SEQ ID NO: 827701

SEQ ID NO: 827723 - protein, 207 aa, Homo sapiens; identical to SEQ ID NO: 827701

SEQ ID NO: 827724 - protein, 207 aa, Homo sapiens; identical to SEQ ID NO: 827701

SEQ ID NO: 827725 - protein, 207 aa, Homo sapiens; identical to SEQ ID NO: 827701

SEQ ID NO: 827726 - protein, 207 aa, Homo sapiens; identical to SEQ ID NO: 827701

SEQ ID NO: 827727 - protein, 188 aa, Homo sapiens
MTRTTPAEYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIPYFETSAKEAINVEQAFQTIARNALKQETEVELYNEFPEPIKLDKNDRAKASAESCSC

SEQ ID NO: 827728 - protein, 207 aa, Homo sapiens; identical to SEQ ID NO: 827701

SEQ ID NO: 827729 - protein, 228 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLAEKNPEKKKKKGGGAKKKFLTSKTDKWQSGHRPGATAKTNIHLKKVPAVFFGGAKEAINVEQAFQTIARNALKQETEVELYNEFPEPIKLDKNDRAKASAESCSC

SEQ ID NO: 827730 - protein, 160 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVATKRAQAWCYSKNNIPYFETSAKEAINVEQAFQTIARNALKQETEVELYNEFPEPIKLDKNDRAKASAESCSC

SEQ ID NO: 827731 - protein, 109 aa, Homo sapiens
RGGGKKTISAGARLGDPENFPFVVLGNKIDLENRQVATKRAQAWCYSKNNIPYFETSAKEAINVEQAFQTIARNALKQETEVELYNEFPEPIKLDKNDRAKASAESCSC

SEQ ID NO: 827732 - protein, 134 aa, Homo sapiens
MTSRKKVLLKVIILGDSGVGKTSLMNQYVNKKFSNQYKATIGADFLTKEVMVDDRLVTMQVATKRAQAWCYSKNNIPYFETSAKEAINVEQAFQTIARNALKQETEVELYNEFPEPIKLDKNDRAKASAESCSC

SEQ ID NO: 827733 - protein, 207 aa, Homo sapiens; identical to SEQ ID NO: 827701

SEQ ID NO: 827734 - protein, 190 aa, Homo sapiens
HEAESNGQHREPRRPSTWSRRSRRLHGMHLSRKRRWSCTTNFLNLSNWTRMTGPRPRQKAAVAEGAVRVEHRVLHKPRTHVGLQHNSPLLFQTKHTLISHIQLPKENPIKHSYTPHISHTHTHTHTHTHRSDVIKLQPLPVMAPWGLPAHPHEPASMAAGQASGGSHSDMELALEAYSFCSLERERTVYS

SEQ ID NO: 827735 - protein, 140 aa, Homo sapiens
MTGPRPRQKAAVAEGAVRVEHRVLHKPRTHVGLQHNSPLLFQTKHTLISHIQLPKENPIKHSYTPHISHTHTHTHTHTHRSDVIKLQPLPVMAPWGLPAHPHEPASMAAGQASGGSHSDMELALEAYSFCSLERERTVYS

SEQ ID NO: 827736 - protein, 176 aa, Homo sapiens
ELGTRKARDMFTRMHLSRKRRWSCTTNFLNLSNWTRMTGPRPRQKAAVAEGAVRVEHRVLHKPRTHVGLQHNSPLLFQTKHTLISHIQLPKENPIKHSYTPHISHTHTHTHTHTHRSDVIKLQPLPVMAPWGLPAHPHEPASMAAGQASGGSHSDMELALEAYSFCSLERERTVYS

SEQ ID NO: 827737 - protein, 140 aa, Homo sapiens; identical to SEQ ID NO: 827735

SEQ ID NO: 827738 - protein, 199 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIPYFETSAKEAINVEQAFQTIARNALKQKRRWSCTGHILILFVSIPCITFS

SEQ ID NO: 827739 - protein, 187 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIPYFETSAKEAINVEQAFQTIARNALKQVGLPQLTSPLW

SEQ ID NO: 827740 - protein, 81 aa, Homo sapiens
RTSARGGGGGGSGSGPGVLAIKPEAAAAAELAAWRARESSLEPELGPSRFCPPFSLLLGGSPRDAPGPEPPAQRPRLKDDL

SEQ ID NO: 827741 - protein, 81 aa, Homo sapiens; identical to SEQ ID NO: 827740

SEQ ID NO: 827742 - protein, 155 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKGPKRGTELE

SEQ ID NO: 827743 - protein, 81 aa, Homo sapiens; identical to SEQ ID NO: 827740

SEQ ID NO: 827744 - protein, 344 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPEEPGMWRRSCGGCRRRGRARCAWTAPCPSSLCRAATWSVLSVPPACSCAPSAEPPSAAACAPSCPRPGAMAGQVGCRVGSLPLSACSGLCSGPAEDGRAGVHPALTSPDSPTTAQGGEGGPCLAWGMA

SEQ ID NO: 827745 - protein, 298 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGGVSPAEAQRAWWVLEPPGARDVEAQLRRLQEERTCKVCLDRAVSIVFVPCGHLVCAECAPGLQLCPICRAPVRSRVRTFLS

SEQ ID NO: 827746 - protein, 256 aa, Homo sapiens
PLPWDYPEAPWRRLHSSPPRPCPRALQGGGRRGPNPDPRGSKGLKQTVGALNPNLHLWGICSCQFLLRSKGRDFVHSVQETHSQLLGSWDPWEEPEDAAPVAPSVPASGYPELPTPRREVQSESAQEPEEPGMWRRSCGGCRRRGRARCAWTAPCPSSLCRAATWSVLSVPPACSCAPSAEPPSAAACAPSCPRPGAMAGQVGCRVGSLPLSACSGLCSGPAEDGRAGVHPALTSPDSPTTAQGGEGGPCLAWGMA

SEQ ID NO: 827747 - protein, 155 aa, Homo sapiens
MSSAPAPGLEDREAFSVAGAGLASWNYFNQRSENPSSAMSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGLCFV

SEQ ID NO: 827748 - protein, 117 aa, Homo sapiens [sequence omitted]

SEQ ID NO: 827749 - protein, 522 aa, Homo sapiens
MSSAPAPGLEDREAFSVAGAGLASWNYFNQRSENPSSAMSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827750 - protein, 522 aa, Homo sapiens; identical to SEQ ID NO: 827749

SEQ ID NO: 827751 - protein, 484 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827752 - protein, 172 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGSFPWFSLNYIPGPAENTTQQFSSAAYPVSLKCPVHIVCFMMRCSFLICITEILLVFANM

SEQ ID NO: 827753 - protein, 172 aa, Homo sapiens; identical to SEQ ID NO: 827752

SEQ ID NO: 827754 - protein, 172 aa, Homo sapiens; identical to SEQ ID NO: 827752

SEQ ID NO: 827755 - protein, 495 aa, Homo sapiens
MSNTTVVPSTAGPGPSGGPGGGGGGGGGGGGTEVIQVTNVSPSASSEQMRTLFGFLGKIDELRLFPPEKLESSKNLLLCDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827756 - protein, 294 aa, Homo sapiens
MSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827757 - protein, 294 aa, Homo sapiens; identical to SEQ ID NO: 827756

SEQ ID NO: 827758 - protein, 491 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASSLHICDSRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827759 - protein, 495 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRVYLKEHGIQERERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827760 - protein, 338 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKRETTTKKQEWHKIS

SEQ ID NO: 827761 - protein, 337 aa, Homo sapiens
TWSDALSMEEGAHYVYDLSLGALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827762 - protein, 465 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVVIMKKTWI

SEQ ID NO: 827763 - protein, 422 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKRFP

SEQ ID NO: 827764 - protein, 273 aa, Homo sapiens
MSNTTVVPSTAGPGPSGGPGGGGGGGGGGGGTEVIQVTNVSPSASSEQMRTLFGFLRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827765 - protein, 484 aa, Homo sapiens; identical to SEQ ID NO: 827751

SEQ ID NO: 827766 - protein, 484 aa, Homo sapiens; identical to SEQ ID NO: 827751

SEQ ID NO: 827767 - protein, 217 aa, Homo sapiens
LKGKCNEDLLNLKRGNLDTPPQAQDQVQSGLFLDVVVRQGASIFQLFPSKDQPLLIRRDAFLILDLCLDILDGVTGLHLEGDGLTSQGLHEDLHPTSETEHQVQGGLFLGSCRIRHEERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827768 - protein, 67 aa, Homo sapiens
DAWVDPRVREEEQGYDSEKEKKEEKKPIETGSPKTKECSVEKGTGDSLRESKVNGDDHHEEDMDMSD

SEQ ID NO: 827769 - protein, 484 aa, Homo sapiens; identical to SEQ ID NO: 827751

SEQ ID NO: 827770 - protein, 484 aa, Homo sapiens; identical to SEQ ID NO: 827751

SEQ ID NO: 827771 - protein, 539 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKKKKEAFQDQDHVLGGGGSLIFKKQGGQEADRRRGAPSKSRSRGGSKAQGERSHSEKSRGPGAIQQSPTAGAHARTCYRTTQQKHGRPPRNVTHTVGGPDRRGTANTRAVGLHKAGAVDTRGGWYRTHT

SEQ ID NO: 827772 - protein, 123 aa, Homo sapiens
VSWLEARWGGRLFSRGLELARSHPLPRGVRRGGETAAAAAASAAVAEAVASDTLLSPAIRFLFPLLLTVCCVFDVLKQEREPEQRHEQHYRRPQHCRSGPQRRARWRRWWWRRRRRHRGNPGD

SEQ ID NO: 827773 - protein, 484 aa, Homo sapiens; identical to SEQ ID NO: 827751

SEQ ID NO: 827774 - protein, 337 aa, Homo sapiens
NAIQDTVYQETAIITESYTQGDRITLEQIELAELFQQDQLLKLMNTVAPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827775 - protein, 484 aa, Homo sapiens; identical to SEQ ID NO: 827751

SEQ ID NO: 827776 - protein, 115 aa, Homo sapiens
MCRAHQKQETKRKKTKKRNVLKHHQKVTAQPDVLEVQAERDDDEEAGVAQDLLKSLGLLKENCPAHHPLGDIKRRRRKIKTKKEVGMKENDQQARRRRVKIRKRTGKENQRVIKM

SEQ ID NO: 827777 - protein, 121 aa, Homo sapiens
ESLEHRRRRLAVNQITPLQSSLGNRADSVSSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 827778 - protein, 198 aa, Homo sapiens
LKGKCNEDLLNLKRGNLDTPPQAQDQVQSGLFLDVVVRQGASIFQLFPSKDQPLLIRRDAFLILDLCLDILDGVTGLHLEGDGLTSQGLHEDLHPTSETEHQVQGGLFLGSCRIRHEERSRDERERSTSKKKKSKDKEKDRERKSESDKDVKQVTRDYDEEEQGYDSEKEKKEEKKPIETGSPKTKECSVVIMKKTWI

SEQ ID NO: 827779 - protein, 482 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDWSPWYPLR

SEQ ID NO: 827780 - protein, 562 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERNATTRTNDVHTTNGHTRTREQTQSDDVDKTTVQHHGYPGTYWLTDGHTGVIEQGGRNRRQQHNNTTEGGGADPIKDTPPVKRGPHTGIYAPIPQQIYHHGSTTRGGHALNNDENVSNKNNKEHNGTTRRTRTAITQEARQDAEHWGRHTPGHPTTREHLIGDTTDNPIT

SEQ ID NO: 827781 - protein, 467 aa, Homo sapiens
MEPGTNSFRVEFPDFSSTILQKLNQQRQQGQLCDVSIVVQGHIFRAHKAVLAASSPYFCDQVLLKNSRRIVLPDVMNPRVFENILLSSYTGRLVMPAPEIVSYLTAASFLQMWHVVDKCTEVLEGNPTVLCQKLNHGSDHQSPSSSSYNGLVESFELGSGGHTDFPKAQELRDGENEEESTKDELSSQLTEHEYLPSNSSTEHDRLSTEMASQDGEEGASDSAEFHYTRPMYSKPSIMAHKRWIHVKPERLEQACEGMDVHATYDEHQVTESINTVQTEHTVQPSGVEEDFHIGEKKVEAEFDEQADESNYDEQVDFYGSSMEEFSGERSDGNLIGHRQEAALAAGYSENIEMVTGIKEEASHLGFSATDKLYPCQCGKSFTHKSQRDRHMSMHLGLRPYGCGVCGKKFKMKHHLVGHMKIHTGIKPYECNICAKRFMWRDSFHRHVTSCTKSYEAAKAEQNTTEAN

SEQ ID NO: 827782 - protein, 467 aa, Homo sapiens; identical to SEQ ID NO: 827781

SEQ ID NO: 827783 - protein, 467 aa, Homo sapiens; identical to SEQ ID NO: 827781

SEQ ID NO: 827784 - protein, 467 aa, Homo sapiens; identical to SEQ ID NO: 827781

SEQ ID NO: 827785 - protein, 467 aa, Homo sapiens; identical to SEQ ID NO: 827781

SEQ ID NO: 827786 - protein, 267 aa, Homo sapiens [sequence omitted]

SEQ ID NO: 827787 - protein, 146 aa, Homo sapiens
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQ

SEQ ID NO: 827788 - protein, 267 aa, Homo sapiens [sequence omitted]

SEQ ID NO: 827789 - protein, 267 aa, Homo sapiens [sequence omitted]

SEQ ID NO: 827790 - protein, 267 aa, Homo sapiens [sequence omitted]

SEQ ID NO: 827791 - protein, 239 aa, Homo sapiens
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQELLGMVLSICLCRHVHSEDYSKVPKY

SEQ ID NO: 827792 - protein, 331 aa, Homo sapiens [sequence omitted]

SEQ ID NO: 827793 - protein, 318 aa, Homo sapiens
EPDPLRLQVGNSVGLFQSPPCCCVDDTWAQAEVGPVTSCTGFVEGSSRTGGMGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIVELLGMVLSICLCRHVHSEDYSKVPKY

SEQ ID NO: 827794 - protein, 214 aa, Homo sapiens [sequence omitted]

SEQ ID NO: 827795 - protein, 236 aa, Homo sapiens
MSELETACGKPMRHKTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIVELLGMVLSICLCRHVHSEDYSKVPKY

SEQ ID NO: 827796 - protein, 292 aa, Homo sapiens
TYWIADEGLLTSCTGFVEGSSRTGGMGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIVELLGMVLSICLCRHVHSEDYSKVPKY

SEQ ID NO: 827797 - protein, 222 aa, Homo sapiens
SRVQPDRGAGRNIGWRASLGARRLGAPGRGPSADFVPALCPQYFAFLLLILIAQVTAGALFYFNMGKLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIVELLGMVLSICLCRHVHSEDYSKVPKY

SEQ ID NO: 827798 - protein, 146 aa, Homo sapiens [sequence omitted]

SEQ ID NO: 827799 - protein, 73 aa, Homo sapiens
LPLLPASQGGCEAQVEDPLNPHVNLDGEAGASEAGTPSLPLTLRLSPQLLGMVLSICLCRHVHSEDYSKVPKY

SEQ ID NO: 827800 - protein, 103 aa, Homo sapiens
AYPLPALSPGCSVVPLLTAHQGSLSNSEKNAPHSVPGAGGLDFYLPSRVCILYRGNCMKNWGGGGRARWLTPVIPALWEAEAGGSRGQEIETILANMVKPRLY

SEQ ID NO: 827801 - protein, 427 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSHRAPQGH

SEQ ID NO: 827802 - protein, 400 aa, Homo sapiens
MGVSGPLVLVLSTEFRHLYLPKYEQTTYTCAHVARETSALKLRPRVHLACVLSVHTPTKHPGATPGASAIGGCPFPEAQAPPSPSRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSHRAPQGH

SEQ ID NO: 827803 - protein, 458 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEVRPCLPVPPTPLLATVTAAYALSMCPSLPPQPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSHRAPQGH

SEQ ID NO: 827804 - protein, 382 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQELGFPSSTGRDESLEHCRCQGLHK

SEQ ID NO: 827805 - protein, 370 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGTTGVSTPAPGV

SEQ ID NO: 827806 - protein, 139 aa, Homo sapiens
MAIFVAVGTRHGTEPMSPQGDGVGYNHHDNCREGHAGRGHLPATVSDWAGRLWHDLRGRAVLGPLCRSWANLGCPVSIPVPQGSTMAGLGELECPCCIPVVRFLPGAGTEARVLGPHGLQPWLSNWAVGQGHFPEVRSW

SEQ ID NO: 827807 - protein, 382 aa, Homo sapiens; identical to SEQ ID NO: 827804

SEQ ID NO: 827808 - protein, 219 aa, Homo sapiens
MGVSGPLVLVLSTEFRHLYLPKYEQTTYTCAHVARETSALKLRPRVHLACVLSVHTPTKHPGATPGASAIGGCPFPEAQAPPSPSRILRFPWQLVQEQVRQTMAEALKVWSDVTPLTFTEVHEGRADIMIDFARYWHGDDLPFDGPGGILAHAFFPKTHREGDVHFDYDETWTIGDDQEGGWTHEGGWTHEGGWTHEGGWTRRGMDTTKGDGHTKGDGH

SEQ ID NO: 827809 - protein, 207 aa, Homo sapiens
MGQNPQPSETALCQDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQVTDLLQVAAIIALWAHTHTPALSF

SEQ ID NO: 827810 - protein, 414 aa, Homo sapiens
MRATAWIVALQGHPGWNRSPGEVDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSHRAPQGH

SEQ ID NO: 827811 - protein, 431 aa, Homo sapiens
MGVSGPLVLVLSTEFRHLYLPKYEQTTYTCAHVARETSALKLRPRVHLACVLSVHTPTKHPGATPGASAIGGCPFPEAQAPPSPSRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEVRPCLPGPPTPLLATVTAAYALSMCPSLPPQPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSHRAPQGH

SEQ ID NO: 827812 - protein, 139 aa, Homo sapiens; identical to SEQ ID NO: 827806

SEQ ID NO: 827813 - protein, 139 aa, Homo sapiens; identical to SEQ ID NO: 827806

SEQ ID NO: 827814 - protein, 229 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQVTDLLQVAAIIALWAHTHTPALSF

SEQ ID NO: 827815 - protein, 382 aa, Homo sapiens
MTEFWLISAPGEKTCQQTWEKLHAATSKNNNLAVTSKFNIPDLKVGTLDVLVGLSDELAKLDAFVEGVVKKVAQYMADVLEDSKDKVQENLLANGVDLVTYITRFQWDMAKYPIKQSLKNISEIIAKGVTQIDNDLKSRASAYNNLKGNLQNLERKNAGSLLTRSLAEIVKKDDFVLDSEYLVTLLVVVPKLNHNDWIKQYETLAEMVVPRSSNVLSEDQDSYLCNVTLFRKAVDDFRHKARENKFIVRDFQYNEEEMKADKEEMNRLSTDKKKQFGPLVRWLKVNFSEAFIAWIHVKALRVFVESVLRYGLPVNFQAMLLQPNKKTLKKLREVLHELYKHLDSSAAAIIDAPMDIPGLNLSQQEYYPYVYYKIDCNLLEFK

SEQ ID NO: 827816 - protein, 191 aa, Homo sapiens
MTEFWLISAPGEKTCQQTWEKLHAATSKNNNLAVTSKFNIPDLKVGTLDVLVGLSDELAKLDAFVEGVVKKVAQYMADVLEDSKDKVQENLLANGVDLVTYITRFQWDMAKYPIKQSLKNISEIIAKGVTQIDNDLKSRASAYNNLKGNLQNLERKNAGSLLTRSLAEIVKKDDFVLDSEYLVTLLVVVPK

SEQ ID NO: 827817 - protein, 50 aa, Homo sapiens
MSSGRCLGGTRVGAGAETVALELELAGWLCLVSRRQFTVLGLGSVSKEEK

SEQ ID NO: 827818 - protein, 382 aa, Homo sapiens; identical to SEQ ID NO: 827815

SEQ ID NO: 827819 - protein, 382 aa, Homo sapiens; identical to SEQ ID NO: 827815

SEQ ID NO: 827820 - protein, 364 aa, Homo sapiens
MTEFWLISAPGENLAVTSKFNIPDLKVGTLDVLVGLSDELAKLDAFVEGVVKKVAQYMADVLEDSKDKVQENLLANGVDLVTYITRFQWDMAKYPIKQSLKNISEIIAKGVTQIDNDLKSRASAYNNLKGNLQNLERKNAGSLLTRSLAEIVKKDDFVLDSEYLVTLLVVVPKLNHNDWIKQYETLAEMVVPRSSNVLSEDQDSYLCNVTLFRKAVDDFRHKARENKFIVRDFQYNEEEMKADKEEMNRLSTDKKKQFGPLVRWLKVNFSEAFIAWIHVKALRVFVESVLRYGLPVNFQAMLLQPNKKTLKKLREVLHELYKHLDSSAAAIIDAPMDIPGLNLSQQEYYPYVYYKIDCNLLEFK

SEQ ID NO: 827821 - protein, 355 aa, Homo sapiens [sequence omitted]

SEQ ID NO: 827822 - protein, 382 aa, Homo sapiens; identical to SEQ ID NO: 827815

SEQ ID NO: 827823 - protein, 382 aa, Homo sapiens; identical to SEQ ID NO: 827815

SEQ ID NO: 827824 - protein, 382 aa, Homo sapiens; identical to SEQ ID NO: 827815

SEQ ID NO: 827825 - protein, 364 aa, Homo sapiens
MTEFWLISAPGEKTCQQTWEKLHAATSKNNNLAVTSKFNIPDLKVGTLDVLVGLSDELAKLDAFVEGVVKKVAQYMADVLEDSKDKVQENLLANGVDLVTYITRFQWDMAKYPIKQSLKSRASAYNNLKGNLQNLERKNAGSLLTRSLAEIVKKDDFVLDSEYLVTLLVVVPKLNHNDWIKQYETLAEMVVPRSSNVLSEDQDSYLCNVTLFRKAVDDFRHKARENKFIVRDFQYNEEEMKADKEEMNRLSTDKKKQFGPLVRWLKVNFSEAFIAWIHVKALRVFVESVLRYGLPVNFQAMLLQPNKKTLKKLREVLHELYKHLDSSAAAIIDAPMDIPGLNLSQQEYYPYVYYKIDCNLLEFK

SEQ ID NO: 827826 - protein, 296 aa, Homo sapiens
MESMAVATDGGERPGVPAGSGLSASQRRAELRRRKLLMNSEQRINRIMGFHRPGSGAEEESQTKSKQQDSDKLNSLSVPSVSKRVVLGDSVSTGTTDQQGGVAEVKGTQLGDKLDSFIKPPECSSDVNLELRQRNRGDLTADSVQRGSRHGLEQYLSRFEEAMKLRKQLISEKPSQEDGNTTEEFDSFRIFRLVGCALLALGVRAFVCKYLSIFAPFLTLQLAYMGLYKYFPKSEKKIKTTVLTAALLLSGIPAEVINRSMDTYSKMGEVFTDLCVYFFTFIFCHELLDYWGSEVP

SEQ ID NO: 827827 - protein, 296 aa, Homo sapiens; identical to SEQ ID NO: 827826

SEQ ID NO: 827828 - protein, 235 aa, Homo sapiens
MESMAVATDGGERPGVPAGSGLSASQRRAELRRRKLLMNSEQRINRIMGFHRPGSGAEEESQTKSKQQDSDKLNSLSVPSVSKRVVLGDSVSTGTTDQQGGVAEVKGTQLGDKLDSFIKPPECSSDVNLELRQRNRGDLTADSVQRGSRHGLEQYLSRFEEAMKLRKQLISEKPSQEDGNTTEEFDSFRIFRLVGCALLALGVRAFVCKYLSIFAPFLTLQLAYMGLYKYFPKVN

SEQ ID NO: 827829 - protein, 235 aa, Homo sapiens; identical to SEQ ID NO: 827828

SEQ ID NO: 827830 - protein, 68 aa, Homo sapiens
RHGLEQYLSRFEEAMKLRKQLISEKPSQEDGNTTEEFDSFRIFRLVGCALLALGVRAFVCKYLVRKDL

SEQ ID NO: 827831 - protein, 924 aa, Homo sapiens
IVSREAKLQFAYLENFKTKMRSTVSVREGQGVVLLCGPPPHSGELSYAWIFNEYPSFVEEDSQEICQELVITPMETGHLYISKVEPSDVGNYTCVVTSMVTNARVLGSPTPLVLRSDGVMGEYEPKIEVQFPETLPAAKGSTVKLECFALGKAPYLRLILEEGWAAISSKIKLRKFSGVLEIPNFQQEDAGSYECIAENSRGKNVARGRLTYYAKPHWVQLIKDVEIAVEDSLYWECRASGKPKPSYRWLKNGAALVLEERTQIENGALTISNLSVTDSGMFQCIAKTNMALLFQCCKVVASAPDFSKNPMKKLVQVQVGSLVSLDCKPRASPRALSSWKKGDVSVQEHERISLLNDGGLKIANVTKADAGTYTCMAENQFGKANGTTHLVVTEPTRITLAPSNMDVSVGESVILPCQVQHDPLLDIIFTWYFNGALADFKKDGSHFEKVGGSSSGDLMIRNIQLKHSGKYVCMVQTGVDSVSSAADLIVRGSPGPPENVKVDEITDTTAQLSWKEGKDNHSPVISYSIQARTPFSVGWQTVTTVPEVIDGKTHTATVVELNPWVEYEFRVVASNKIGGGEPSLPSEKVRTEEAVPEVPPSEVNGGGGSRSELVITWDPVPEELQNGEGFGYVVAFRPLGVTTWIQTVVTSPDTPRYVFRNESIVPYSPYEVKVGVYNNKGEGPFSPVTTVFSAEEEPTVAPSQVSANSLSSSEIEVSWNTIPWKLSNGHLLGYEVRYWNGGGKEESSSKMKVAGNETSARLRGLKSNLAYYTAVRAYNSAGAGPFSATVNVTTKKTPPSQPPGNVVWNATDTKVLLNWEQVKAMENESEVTGYKVFYRTSSQNNVQVLNTNKTSAELVLPIKEDYIIEVKATTDGGDGTSSEQIRIPRITSMDARGSTSAISNVHPMSSYMPIVLFLIVYVLW

SEQ ID NO: 827832 - protein, 101 aa, Homo sapiens
RSRALRARRDVSSLPARGPARPGPRPEPQRAEDVSPARLWRSSSHSRAEPERSAAQPRALSGPLARVPRSCPSGVPRPLAGATAAAARGPSPAGRPRPQRR

SEQ ID NO: 827833 - protein, 111 aa, Homo sapiens
QRETETQGWRGGGTRETEGGRDRDKAPERGAEAGETEPRTRVWGGRRSRRNNKGDRHLRQGETETSIGCRPSRRGTMEGLRKARLSRDVVIEDDRIDDVLKNMTDKAPPGV

SEQ ID NO: 827834 - protein, 101 aa, Homo sapiens; identical to SEQ ID NO: 827832

SEQ ID NO: 827835 - protein, 101 aa, Homo sapiens; identical to SEQ ID NO: 827832

SEQ ID NO: 827836 - protein, 30 aa, Homo sapiens
MAASAGPAVPPGCISRPSSCLPASKLFRLS

SEQ ID NO: 827837 - protein, 933 aa, Homo sapiens
MNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQDEVMKSPGLYAIEEGEQEKRKRSLKLILEKKLAILERAIESNQSSVDLKLAKLKLCTEFWEPSTLVKEWQKLIFLHPNNTALWQKYLLFCQSQFSTFSISKIHSLYGKCLSTLSAVKDGSILSHPALPGTEEAMFALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTLPRWQIWLAAERSRDQRHWRPWRPDKTKKQTEEDCEDPERQVLFDDIGQSLIRLSSHDLQFQLVEAFLQFLGVPSGFTPPASCLYLAMDENSIFDNGLYDEKPLTFFNPLFSGASCVGRMDRLGYPRWTRGQNREGEEFIRNVFHLVMPLFSGKEKSQLCFSWLQYEIAKVIWCLHTKNKKRLKSQGKNCKKLAKNLLKEPENCNNFCLWKQYAHLEWLLGNTEDARKVFDTALGMAGSRELKDSDLCELSLLYAELEVELSPEVRRAATARAVHILTKLTESSPYGPYTGQVLAVHILKARKAYEHALQDCLGDSCVSNPAPTDSCSRLISLAKCFMLFQYLTIGIDAAVQIYEQVFAKLNSSVFPEGSGEGDSASSQSWTSVLEAITLMHTSLLRFHMKVSVYPLAPLREALSQALKLYPGNQVLWRSYVQIQNKSHSASKTRRFFDTITRSAKPLEPWLFAIEAEKLRKRLVETVQRLDGREIHATIPETGLMHRIQALFENAMRSDSGSQCPLLWRMYLNFLVSLGNKERSKGVFYKALQNCPWAKVLYLDAVEYFPDEMQEILDLMTEKELRVRLPLEELELLLED

SEQ ID NO: 827838 - protein, 933 aa, Homo sapiens; identical to SEQ ID NO: 827837

SEQ ID NO: 827839 - protein, 597 aa, Homo sapiens
MALFPAFAGLSEAPDGGSSRKELDWLSNPSFCVGSITSLSQQTEAAPAHVSEGLPLTRSHLKSESSDESDTNKKLKQTSRKKKKEKKKKRKHQHHKKTKRKHGPSSSSRSETDTDSEKDKPSRGVGGSKKESEEPNQGNNAAADTGHRFVWLEDIQAVTGETFRTDKKPDPANWEYKSLYRGDIARYKRKGDSCLGINPKKQCISWEGTSTEKKHSRKQVERYFTKKSVGLMNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQDEVMKSPGLYAIEEGEQEKRKRSLKLILEKKLAILERAIESNQSSVDLKLAKLKLCTEFWEPSTLVKEWQKLIFLHPNNTALWQKYLLFCQSQFSTFSISKIHSLYGKCLSTLSAVKDGSILSHPALPGTEEAMFALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTAAGGLESSGKTGCACEAKLPTLRS

SEQ ID NO: 827840 - protein, 604 aa, Homo sapiens
MALFPAFAGLSEAPDGGSSRKELDWLSNPSFCVGSITSLSQQTEAAPAHVSEGLPLTRSHLKSESSDESDTNKKLKQTSRKKKKEKKKKRKHQHHKKTKRKHGPSSSSRSETDTDSEKDKPSRGVGGSKKESEEPNQGNNAAADTGHRFVWLEDIQAVTGETFRTDKKPDPANWEYKSLYRGDIARYKRKGDSCLGINPKKQCISWEGTSTEKKHSRKQVERYFTKKSVGLMNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQDEVMKSPGLYAIEEGEQEKRKRSLKLILEKKLAILERAIESNQSSVDLKLAKLKLCTEFWEPSTLVKEWQKLIFLHPNNTALWQKYLLFCQSQFSTFSISKIHSLYGKCLSTLSAVKDGSILSHPALPGTEEAMFALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTLPRWQIWLAAERSRDQRHWRPWRPDKTKNYQ

SEQ ID NO: 827841 - protein, 164 aa, Homo sapiens
MALFPAFAGLSEAPDGGSSRKELDWLSNPSFCVGSITSLSQQTEAAPAHVSEGLPLTRSHLKSESSDESDTNKKLKQTSRKKKKEKKKKRKHQHHKKTKRKHGPSSSSRSETDTDSEKDKPSRGVGGSKKESEEPNQGNNAAADTGHRFVWLEDIQAVTGETFR

SEQ ID NO: 827842 - protein, 1164 aa, Homo sapiens
MALFPAFAGLSEAPDGGSSRKELDWLSNPSFCVGSITSLSQQTEAAPAHVSEGLPLTRSHLKSESSDESDTNKKLKQTSRKKKKEKKKKRKHQHHKKTKRKHGPSSSSRSETDTDSEKDKPSRGVGGSKKESEEPNQGNNAAADTGHRFVWLEDIQAVTGETFRTDKKPDPANWEYKSLYRGDIARYKRKGDSCLGINPKKQCISWEGTSTEKKHSRKQVERYFTKKSVGLMNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQDEVMKSPGLYAIEEGEQEKRKRSLKLILEKKLAILERAIESNQSSVDLKLAKLKLCTEFWEPSTLVKEWQKLIFLHPNNTALWQKYLLFCQSQFSTFSISKIHSLYGKCLSTLSAVKDGSILSHPALPGTEEAMFALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTLPRWQIWLAAERSRDQRHWRPWRPDKTKKQTEEDCEDPERQVLFDDIGQSLIRLSSHDLQFQLVEAFLQFLGVPSGFTPPASCLYLAMDENSIFDNGLYDEKPLTFFNPLFSGASCVGRMDRLGYPRWTRGQNREGEEFIRNVFHLVMPLFSGKEKSQLCFSWLQYEIAKVIWCLHTKNKKRLKSQGKNCKKLAKNLLKEPENCNNFCLWKQYAHLEWLLGNTEDARKVFDTALGMAGSRELKDSDLCELSLLYAELEVELSPEVRRAATARAVHILTKLTESSPYGPYTGQVLAVHILKARKAYEHALQDCLGDSCVSNPAPTDSCSRLISLAKCFMLFQYLTIGIDAAVQIYEQVFAKLNSSVFPEGSGEGDSASSQSWTSVLEAITLMHTSLLRFHMKVSVYPLAPLREALSQALKLYPGNQVLWRSYVQIQNKSHSASKTRRFFDTITRSAKPLEPWLFAIEAEKLRKRLVETVQRLDGREIHATIPETGLMHRIQALFENAMRSDSGSQCPLLWRMYLNFLVSLGNKERSKGVFYKALQNCPWAKVLYLDAVEYFPDEMQEILDLMTEKELRVRLPLEELELLLED

SEQ ID NO: 827843 - protein, 1157 aa, Homo sapiens
MALFPAFAGLSEAPDGGSSRKELDWLSNPSFCVGSITSLSQQTEAAPAHVSEGLPLTRSHLKSESSDESDTNKKLKQTSRKKKKEKKKKRKHQHHKKTKRKHGPSSSSRSETDTDSEKDKPSRGVGGSKKESEEPNQGNNAAADTGHRFVWLEDIQAVTGETFRTDKKPDPANWEYKSLYRGDIARYKRKGDSCLGINPKKQCISWEGTSTEKKHSRKQVERYFTKKSVGLMNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQDEVMKSPGLYAIEEGEQEKRKRSLKLILEKKLAILERAIESNQSSVDLKLAKLKLCTEFWEPSTLVKEWQKLIFLHPNNTALWQKYLLFCQSQFSTFSISKIHSLYGKCLSTLSAVKDGSILSHPALPGTEEAMFALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTLPRWQIWLAAERSRDQRHWRPWRPDKTKKQTEEDCEDPERQVLFDDIGQSLIRLSSHDLQFQLVEAFLQFLGVPSGFTPPASCLYLAMDENSIFDNGLYDEKPLTFFNPLFSGASCVGRMDRLGYPRWTRGQNREGEEFIRNVFHLVMPLFSGKEKSQLCFSWLQYEIAKVIWCLHTKNKKRLKSQGKNCKKLAKNLLKEPENCNNFCLWKQYAHLEWLLGNTEDARKVFDTALGMAGSRELKDSDLCELSLLYAELEVELSPEVRRAATARAVHILTKLTESSPYGPYTGQVLAVHILKARKAYEHALQDCLGDSCVSNPAPTDSCSRLISLAKCFMLFQYLTIGIDAAVQIYEQVFAKLNSSVFPEGSGEGDSASSQSWTSVLEAITLMHTSLLRFHMKVSVYPLAPLREALSQALKLYPGNQVLWRSYVQIQNKSHSASKTRRFFDTITRSAKPLEPWLFAIEAEKLRKRLVETVQRLDGREIHATIPETGLMHRIQALFENAMRSDSGSQCPLLWRMYLNFLVSLGNKERSKGVFYKALQNCPWAKVLYLDAVEYFPDEMQEILDLMTEKELRVRLLLED

SEQ ID NO: 827844 - protein, 219 aa, Homo sapiens
MALFPAFAGLSEAPDGGSSRKELDWLSNPSFCVGSITSLSQQTEAAPAHVSEGLPLTRSHLKSESSDESDTNKKLKQTSRKKKKEKKKKRKHQHHKKTKRKHGPSSSSRSETDTDSEKDKPSRGVGGSKKESEEPNQGNNAAADTGHRFVWLEDIQAVTGETFRTDKKPDPANWEYKSLYRGDIARSHLKSESSDESDTNKKLKQTSRKKKKENKKKRK

SEQ ID NO: 827845 - protein, 455 aa, Homo sapiens
HTAIGGCSDPGLPQGVPQQCLAAWAGTLSLKQRSHFFWAHEAAVPCSAEHGGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 827846 - protein, 78 aa, Homo sapiens
LILALVATIFFVCTVVLAVRLSRKGHMYPVRNYSPTEMVCISSLLPDGGEGPSATANGGLSKAKKPWQQLAAVGHLGR

SEQ ID NO: 827847 - protein, 455 aa, Homo sapiens; identical to SEQ ID NO: 827845

SEQ ID NO: 827848 - protein, 465 aa, Homo sapiens
HTAIGGCSDPGLPQGVPQQCLAAWAGTLSLKQRSHFFWAHEAAVPCSAEHGGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 827849 - protein, 280 aa, Homo sapiens
REVGAGAGSAVPGPRDPHLAPSVRTSLSAHSADPPAARRQQRQHPGPHRVSAAGADRAVGSGQPPGPRGASCPRGGRCPAERPRSPRTRLQAPVAASRRPTCFCPSGSSGSWPCPSLWPAPRWVTCPRRPGAGRWGEGKRSLGSPPGSARPGVFLSLSLPGSATGSPVQRALGWSPSFSRAGGWRGTRAASECALVGVWSEPTCIPTHVLAARGVVAASRGHLDARPWREVSYAVVSAPGSAAARGGCCVLRARSPGLGFVVVGVVSPSLLPPRTSFVRS

SEQ ID NO: 827850 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 827851 - protein, 1344 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEELDLEPENMESVPLDPSASSSSLPLPDRHSGHKAENGPGPGVLVLRASFDERQPYAHMNGGRKNERALPLPQSSTC

SEQ ID NO: 827852 - protein, 764 aa, Homo sapiens
LLTSGDLPASASQSAGIIALSHHIWPRPAIFLIKGTESYYFSLQACITAFIPTLVLAFLFREDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 827853 - protein, 403 aa, Homo sapiens
MTVNYRNSNASVNPEYFSAAEVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 827854 - protein, 150 aa, Homo sapiens
MKSGSGGGSPTSLWGLLFLSAALSLWPTSGESEYVPAARGHCGNFSSEGLRPVCETRVATVAAVGPPGSGAAGWGAGRLCREGGCSGPGTRARSSGAPRPWPWFCCGRRRRRPLFCRPALPLYVVNKQCRSTFAVFCNLIAFVLVVSGGG

SEQ ID NO: 827855 - protein, 1367 aa, Homo sapiens; identical to SEQ ID NO: 827850

SEQ ID NO: 827856 - protein, 1367 aa, Homo sapiens; identical to SEQ ID NO: 827850

SEQ ID NO: 827857 - protein, 570 aa, Homo sapiens
VWMGGLFSGQPSVGLPPWEPKSNFVTCLNCTEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 827858 - protein, 290 aa, Homo sapiens
GPPVNKRQGMPRWAASRQLKGPLSVPLGLLHHWLLSLTLSPLVSVCLSLSPSVCLCLPLSLSLFLSPVSVSFYLPLSLSILYVSCFCLYLPLSLSLQASLSLSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 827859 - protein, 1255 aa, Homo sapiens
MLDPSSSEEESDEGLEEESRDVLVAAGSSQRAPPAPTREGRRDAPGRAGGGGAARSVSPSPSVLSEGRDEPQRQLDDEQERRIRLQLYVFVVRCIAYPFNAKQPTDMARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLYADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVNNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEFGSQWQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 827860 - protein, 1255 aa, Homo sapiens; identical to SEQ ID NO: 827859

SEQ ID NO: 827861 - protein, 499 aa, Homo sapiens
DEPSRAKRSWATVHARRVLAAPPLLRALSAPDTSTACREQAGGRCGGLAHLVEEQLWGFFFFHCRIQAFQRETVEMHNLQTLPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 827862 - protein, 724 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 827863 - protein, 724 aa, Homo sapiens; identical to SEQ ID NO: 827862

SEQ ID NO: 827864 - protein, 454 aa, Homo sapiens
MYNTVWNMEDLDLEYAKTDINCGTDLMFYIEMDPPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 827865 - protein, 610 aa, Homo sapiens
QLERSWRKQRQRRGRQASCRRRQARIGHGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 827866 - protein, 705 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAEQFFFLLSRVDGEVKHCVINKTATGYGFAEPYNLYSSLKELVLHYQHTSLVQHNDSLNVTLAYPVYAQQRR

SEQ ID NO: 827867 - protein, 724 aa, Homo sapiens; identical to SEQ ID NO: 827862

SEQ ID NO: 827868 - protein, 724 aa, Homo sapiens; identical to SEQ ID NO: 827862

SEQ ID NO: 827869 - protein, 724 aa, Homo sapiens; identical to SEQ ID NO: 827862

SEQ ID NO: 827870 - protein, 724 aa, Homo sapiens; identical to SEQ ID NO: 827862

SEQ ID NO: 827871 - protein, 707 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKAREIAKLGSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 827872 - protein, 499 aa, Homo sapiens; identical to SEQ ID NO: 827861

SEQ ID NO: 827873 - protein, 605 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEE

SEQ ID NO: 827874 - protein, 683 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEKHCVINELVLHYPPLPW

SEQ ID NO: 827875 - protein, 372 aa, Homo sapiens
MSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 827876 - protein, 397 aa, Homo sapiens
RTPAPEGGPAAGCPGPLGGPVAACGMSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 827877 - protein, 321 aa, Homo sapiens
RARARGPGLPLRGAVAREGGGGAVVRGSAGPWVALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 827878 - protein, 372 aa, Homo sapiens; identical to SEQ ID NO: 827875

SEQ ID NO: 827879 - protein, 323 aa, Homo sapiens
MSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQR

SEQ ID NO: 827880 - protein, 129 aa, Homo sapiens
MSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVAWKGGRYV

SEQ ID NO: 827881 - protein, 372 aa, Homo sapiens; identical to SEQ ID NO: 827875

SEQ ID NO: 827882 - protein, 243 aa, Homo sapiens [sequence omitted]

SEQ ID NO: 827883 - protein, 372 aa, Homo sapiens; identical to SEQ ID NO: 827875

SEQ ID NO: 827884 - protein, 323 aa, Homo sapiens
MSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRSYAGYLQVGQLRSQFEIRSHETGLGGRSETLTDPEGELQAELKATIKHGITPEDSKRDKGCRAFVAPTKAPPKRNN

SEQ ID NO: 827885 - protein, 127 aa, Homo sapiens
RARARGPGLPLRGAVAREGGGGAVVRGSAGPWVCPAARPRPAPRGGSAPWPAAAAAAAAAGGDPGAAVAADRAAGGGGAGPWGTEPSAAAGAGSPAQVGAASPAEPRAPGQQPDARAHWAGQWPPAG

SEQ ID NO: 827886 - protein, 646 aa, Homo sapiens
TGDCCQGSGEFRMTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQAGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQVIKPRRKLAFRSGEARDWSNGAVLQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 827887 - protein, 634 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQAGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQVIKPRRKLAFRSGEARDWSNGAVLQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 827888 - protein, 634 aa, Homo sapiens; identical to SEQ ID NO: 827887

SEQ ID NO: 827889 - protein, 564 aa, Homo sapiens
LNLEDKTTGSVAHGLPTADSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQAGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQVIKPRRKLAFRSGEARDWSNGAVLQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 827890 - protein, 262 aa, Homo sapiens [sequence omitted]

SEQ ID NO: 827891 - protein, 634 aa, Homo sapiens; identical to SEQ ID NO: 827887

SEQ ID NO: 827892 - protein, 386 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPNTGHAAEARPQFLAAKFHQG

SEQ ID NO: 827893 - protein, 409 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQDVRISVWV

SEQ ID NO: 827894 - protein, 634 aa, Homo sapiens; identical to SEQ ID NO: 827887

SEQ ID NO: 827895 - protein, 101 aa, Homo sapiens
GDGPVLWGSPSVTLGRPADRTDFAFNPRLCEVIKPRRKLAFRSGEARDWSNGAVLQVRTALGAGSLAPPPQPVTTSVADCHAASSVCLSLFLFHFSPQISH

SEQ ID NO: 827896 - protein, 120 aa, Homo sapiens
MYFHKSSKTACFKKSVGGSGPCKSGSWYRWQTSSARMPGSVIPPPLVRGGQQASSKLGPQASSQVVMPPLVRGAQVSRAVHMGETWQPQQSSTVKVGSFPVLGGKVQCAFRSRSIVDLGL

SEQ ID NO: 827897 - protein, 634 aa, Homo sapiens; identical to SEQ ID NO: 827887

SEQ ID NO: 827898 - protein, 646 aa, Homo sapiens; identical to SEQ ID NO: 827886

SEQ ID NO: 827899 - protein, 609 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQAGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 827900 - protein, 634 aa, Homo sapiens; identical to SEQ ID NO: 827887

SEQ ID NO: 827901 - protein, 121 aa, Homo sapiens
MLQRQDLNSWLQSFIRARGLVPPHRQTRIIAGGPFPWAFFLSLFAFSLPDTSRKVDLGGWFCSWPPCSAPAGTRAAHPGHCDAHGQGQRPGLLNRAGCFIFLLFPVLGSQSLTAFPWRSIS

SEQ ID NO: 827902 - protein, 481 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQAGRMSAATVLSREPYMCAQCKTDFTCRWREEKSGAIMCENCMTTNQKKGVPCPRTYVCLHEFWAPLVPIELQPWFSYPCS

SEQ ID NO: 827903 - protein, 196 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGTVDRDPLDHPPT

SEQ ID NO: 827904 - protein, 160 aa, Homo sapiens
MVPSAGQLALFALGIVLAACQALENSTSPLSADPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 827905 - protein, 163 aa, Homo sapiens
MVPSAGQLALFALGIVLAACQALENSTSPLSADPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETGCRLY

SEQ ID NO: 827906 - protein, 162 aa, Homo sapiens
MVPSAGQLALFALGIVLAACQALENSTSPLSADPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETATLG

SEQ ID NO: 827907 - protein, 123 aa, Homo sapiens
AACQALENSTSPLSGECSCRGCVDRVWEGSGPAAVWLLKSSLPGLLPTEHTPVPESSLPPPQGRGGAHWKVLTAGPRGGCSWPPQGPPLRVSLQLFRQFLWASVPKQGLQDPRAWGQLFSPLS

SEQ ID NO: 827908 - protein, 160 aa, Homo sapiens; identical to SEQ ID NO: 827904

SEQ ID NO: 827909 - protein, 160 aa, Homo sapiens; identical to SEQ ID NO: 827904

SEQ ID NO: 827910 - protein, 160 aa, Homo sapiens; identical to SEQ ID NO: 827904

SEQ ID NO: 827911 - protein, 152 aa, Homo sapiens
NKETEDCEGERSKPRRRWKGWRTHLNMWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKH

SEQ ID NO: 827912 - protein, 304 aa, Homo sapiens
MKRAHPEYSSSDSELDETIEVEKESADENGNLSSALGSMSPTTSSQILARKRRRGIIEKRRRDRINNSLSELRRLVPSAFEKQGSAKLEKAEILQMTVDHLKMLHTAGGKGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHPEAPALRAPPSGSLGPVLPVVTSASKLSPPLLSSVASLSAFPFSFGSFHLLSPNALSPSAPTQAANLGKPYRPWGTEIGAF

SEQ ID NO: 827913 - protein, 72 aa, Homo sapiens
CNQVSSTGGGMGMVTVVLLMSPMMLSASFSAWCMCSISSCCCACSANSSISVFWFPHEYILASGSEMMNSGV

SEQ ID NO: 827914 - protein, 581 aa, Homo sapiens
METRGSRLTGGQGRVYNFLERPTGWKCFVYHFAVFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 827915 - protein, 712 aa, Homo sapiens
AAGLAAVAARTAPGRSPSLQLPVPPLGPAPRQALLVMAAASSPPRAERKRWGWGRLPGARRGSAGLAKKCPFSLELAEGGPAGGALYAPIAPGAPGPAPPASPAAPAAPPVASDLGPRPPVSLDPRVSIYSTRRPVLARTHVQGRVYNFLERPTGWKCFVYHFAVFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 827916 - protein, 153 aa, Homo sapiens [sequence omitted]

SEQ ID NO: 827917 - protein, 165 aa, Homo sapiens
AAGLAAVAARTAPGRSPSLQLPVPPLGPAPRQALLVMAAASSPPRAERKRWGWGRLPGARRGSAGLAKKCPFSLELAEGGPAGGALYAPIAPGAPGPAPPASPAAPAAPPVASDLGPRPPVSLDPRVSIYSTRRPVLARTHVQGRVYNFLERPTGWKCFVYHFAV

SEQ ID NO: 827918 - protein, 549 aa, Homo sapiens
MDFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 827919 - protein, 549 aa, Homo sapiens; identical to SEQ ID NO: 827918

SEQ ID NO: 827920 - protein, 743 aa, Homo sapiens
AAGLAAVAARTAPGRSPSLQLPVPPLGPAPRQALLVMAAASSPPRAERKRWGWGRLPGARRGSAGLAKKCPFSLELAEGGPAGGALYAPIAPGAPGPAPPASPAAPAAPPVASDLGPRPPVSLDPRVSIYSTRRPVLARTHVQGRVYNFLERPTGWKCFVYHFAVIQEIKHTVTRVQSSVKRSSGYTPRGFSFDPGFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 827921 - protein, 680 aa, Homo sapiens
AAGLAAVAARTAPGRSPSLQLPVPPLGPAPRQALLVMAAASSPPRAERKRWGWGRLPGARRGSAGLAKKCPFSLELAEGGPAGGALYAPIAPGAPGPAPPASPAAPAAPPVASDLGPRPPVSLDPRVSIYSTRRPVLARTHVQGRVYNFLERPTGWKCFVYHFAVFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPATAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 827922 - protein, 549 aa, Homo sapiens; identical to SEQ ID NO: 827918

SEQ ID NO: 827923 - protein, 471 aa, Homo sapiens
TLEDLWSLYRGLQGAECLPRRHQGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 827924 - protein, 545 aa, Homo sapiens
AAGLAAVAARTAPGRSPSLQLPVPPLGPAPRQALLVMAAASSPPRAERKRWGWGRLPGARRGSAGLAKKCPFSLELAEGGPAGGALYAPIAPGAPGPAPPASPAAPAAPPVASDLGPRPPVSLDPRVSIYSTRRPVLARTHVQGRVYNFLERPTGWKCFVYHFAVFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISHLRKC

SEQ ID NO: 827925 - protein, 179 aa, Homo sapiens
QQQPRLIVWAGVTGAVEWLCPQPGVRPVSPWEWNGMGLHSWQCGQLRQPPRALRGQRWRAWSRMEPRSPAAAMPGHRTTPEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 827926 - protein, 458 aa, Homo sapiens
AAGLAAVAARTAPGRSPSLQLPVPPLGPAPRQALLVMAAASSPPRAERKRWGWGRLPGARRGSAGLAKKCPFSLELAEGGPAGGALYAPIAPGAPGPAPPASPAAPAAPPVASDLGPRPPVSLDPRVSIYSTRRPVLARTHVQGRVYNFLERPTGWKCFVYHFAVFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVSSPP

SEQ ID NO: 827927 - protein, 584 aa, Homo sapiens
MNSPGGRGKKKGSGGASNPVPPRPPPPCLAPAPPAAGPAPPPESPHKRNLYYFSYPLFVGFALLRLVAFHLGLLFVWLCQRFSRALMAAKRSSGAAPAPASASAPAPVPGGEAERVRVFHKQAFEYISIALRIDEDEKAGQKEQAVEWYKKGIEELEKGIAVIVTGQGEQCERARRLQAKMMTNLVMAKDRLQLLESGAVPKRKDPLTHTSNSLPRSKTVMKTGSAGLSGHHRAPSYSGLSMVSGVKQGSGPAPTTHKGTPKTNRTNKPSTPTTATRKKKDLKNFRNVDSNLANLIMNEIVDNGTAVKFDDIAGQDLAKQALQEIVILPSLRPELFTGLRAPARGLLLFGPPGNGKTMLAKAVAAESNATFFNISAASLTSKYVGEGEKLVRALFAVARELQPSIIFIDEVDSLLCERREGEHDASRRLKTEFLIEFDGVQSAGDDRVLVMGATNRPQELDEAVLRRFIKRVYVSLPNEETRLLLLKNLLCKQGSPLTQKELAQLARMTDGYSGSDLTALAKDAALGPIRELKPEQVKNMSASEMRNIRLSDFTESLKKIKRSVSPQTLEAYIRWNKDFGDTTV

SEQ ID NO: 827928 - protein, 616 aa, Homo sapiens
MNSPGGRGKKKGSGGASNPVPPRPPPPCLAPAPPAAGPAPPPESPHKRNLYYFSYPLFVGFALLRLVAFHLGLLFVWLCQRFSRALMAAKRSSGAAPAPASASAPAPVPGGEAERVRVFHKQAFEYISIALRIDEDEKAGQKEQAVEWYKKGIEELEKGIAVIVTGQGEQCERARRLQAKMMTNLVMAKDRLQLLEKMQPVLPFSKSQTDVYNDSTNLACRNGHLQSESGAVPKRKDPLTHTSNSLPRSKTVMKTGSAGLSGHHRAPSYSGLSMVSGVKQGSGPAPTTHKGTPKTNRTNKPSTPTTATRKKKDLKNFRNVDSNLANLIMNEIVDNGTAVKFDDIAGQDLAKQALQEIVILPSLRPELFTGLRAPARGLLLFGPPGNGKTMLAKAVAAESNATFFNISAASLTSKYVGEGEKLVRALFAVARELQPSIIFIDEVDSLLCERREGEHDASRRLKTEFLIEFDGVQSAGDDRVLVMGATNRPQELDEAVLRRFIKRVYVSLPNEETRLLLLKNLLCKQGSPLTQKELAQLARMTDGYSGSDLTALAKDAALGPIRELKPEQVKNMSASEMRNIRLSDFTESLKKIKRSVSPQTLEAYIRWNKDFGDTTV

SEQ ID NO: 827929 - protein, 616 aa, Homo sapiens; identical to SEQ ID NO: 827928

SEQ ID NO: 827930 - protein, 616 aa, Homo sapiens; identical to SEQ ID NO: 827928

SEQ ID NO: 827931 - protein, 616 aa, Homo sapiens; identical to SEQ ID NO: 827928

SEQ ID NO: 827932 - protein, 279 aa, Homo sapiens
MVKPHLDAATAWAGLRLGTSHRLVRATRRMAETLRRVLTRGGAAWSGEENMPAAGPPLLLLGTPGSGKTALLFAAALEAAGEGQGPVLFLTRRPLQSMPRGTGTTLDPMRLQKIRFQYPPSTRELFRLLCSAHEAPGPAPSLLLLDGLEEYLAEDPEPQEAAYLIALLLDTAAHFSHRLGPGRDCGLMVALQTQEEAGSGDVLHLALLQRYFPAQCWLQPDAPGPGEHGLRACLEPGGLGPRTEWWVTFRSDGEMMIAPWPTQAGDPSSGKGSSSGGQP

SEQ ID NO: 827933 - protein, 168 aa, Homo sapiens
MKIRFQYPPSTRELFRLLCSAHEAPGPAPSLLLLDGLEEYLAEDPEPQEAAYLIALLLDTAAHFSHRLGPGRDCGLMVALQTQEEAGSGDVLHLALLQRYFPAQCWLQPDAPGPGEHGLRACLEPGGLGPRTEWWVTFRSDGEMMIAPWPTQAGDPSSGKGSSSGGQP

SEQ ID NO: 827934 - protein, 215 aa, Homo sapiens
MVKPHLDAATAWAGLRLGTSHRLVRATRRMAETLRRVLTRGGAAWSGEENMPAAGPPLLLLGTPGSGKTALLFAAALEAAGEGQGPVLFLTRRPLQSMPRGTGTTLDPMRLQKIRFQYPPSTRELFRLLCSAHEAPGPAPSLLLLDGLEEYLAEDPEPPSRPRRKQVVGTSCTWHCSSGIFLPSAGCSQMHQVQESTASEPAWSQAGWAPEQSGG

SEQ ID NO: 827935 - protein, 2941 aa, Homo sapiens
GAGGGAAAAVDPAAGRELGEMRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSDSDETSI

SEQ ID NO: 827936 - protein, 1139 aa, Homo sapiens
CAACGRLEDPRIPAFAIWEAEAGLLKPRSSRPTWATWRNPVSTKNTKSRQMWWYVPMVPATQEAEVGGLLEPRGLRLQRAVIMPLHSKSAKCRNWRQFLHFADLAHCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSDSDETSI

SEQ ID NO: 827937 - protein, 1133 aa, Homo sapiens
AFCCPADSRSPPIPALCRFGNVSVLLWYMEFLKWVPKHATPLSLKPLKVMRHHSCDYVVICQLYDFKMVRLPHELDLITSLQIGKVQELAPIPALCRFGNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSDSDETSI

SEQ ID NO: 827938 - protein, 2474 aa, Homo sapiens
GAGGGAAAAVDPAAGRELGEMRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLEVVFRNESHVSCQCNHMTSFAVLLPLSSPLSNSCKGLKI

SEQ ID NO: 827939 - protein, 111 aa, Homo sapiens
EWGTPSCRAPLVSSLIPHILLWPHLTAPPRPTGILKKKCLPTISEKSSLLRLPLEQCTGSSRGSSASEGSRGGPPPRPPPRQSLQEQLNGVMPIAMSIKAGTVDEDSSGSE

SEQ ID NO: 827940 - protein, 2943 aa, Homo sapiens
GAGGGAAAAVDPAAGRELGEMRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSEFLFFNFLH

SEQ ID NO: 827941 - protein, 2033 aa, Homo sapiens
LGASPCPLHMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSDSDETSI

SEQ ID NO: 827942 - protein, 2487 aa, Homo sapiens
GAGGGAAAAVDPAAGRELGEMRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPVRCSYCPETVPTFSGRLPSPHWQPLLLHHEL

SEQ ID NO: 827943 - protein, 126 aa, Homo sapiens
MNSNKVPSAAPGPGFPLLWLPRDPPAPASGPGFPGSSSQHPGPPPCLTRSRACALGGPRSLTCPGLGPQFACTVIAILLHFLYLCTFSWALLEALHLYRALTEVRDVNTGPMRFYYMLGWGVPAFI

SEQ ID NO: 827944 - protein, 212 aa, Homo sapiens
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLGL

SEQ ID NO: 827945 - protein, 83 aa, Homo sapiens
ARSSRLLRSGRVPGRGSTEGSPRRRSRASVLLETYFRLQMGKGASTLTNPREPQARGWEKPEMPTSCFRSSGWVLKHRCFCIE

SEQ ID NO: 827946 - protein, 82 aa, Homo sapiens
MADLIDGYCRLQGEHQGSLIIHPRKDGEKRNSLPQIPMLNLEARRSHLSESCSIGELPAASSTISWLIFIFIEAGLSIYLAT

SEQ ID NO: 827947 - protein, 116 aa, Homo sapiens
VSCLDSAFDQFEVLPRIEAVAIEADLEDTHVLLFHIYWYPHPCPADLSTDPLRKPTSWLQSCSSRFLRVCVPALLRSPALWSIHLPLTHCTRHIFNWTLANQLATEMSEATLPLTA

SEQ ID NO: 827948 - protein, 96 aa, Homo sapiens
ASLMLDLSPHQLRNDYMQRYASKVSEGMALQLGCLELRRFFKDMPHNALDKKSNFELLEKEVGLDLFFPKQMQENLKPKQFRKMIQQDDQDSRMIR

SEQ ID NO: 827949 - protein, 61 aa, Homo sapiens
GVWTSLLPEPLVVLHHLLLLFVQDLPSRPKYRPPPQTNLLAPKLQFQVKIEPEDGNFRSTS

SEQ ID NO: 827950 - protein, 1009 aa, Homo sapiens
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQVPEGLCASSPTLTSPMEYPSPVNSLHTPPLHRHNVFKRHSMREEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 827951 - protein, 1009 aa, Homo sapiens; identical to SEQ ID NO: 827950

SEQ ID NO: 827952 - protein, 1009 aa, Homo sapiens; identical to SEQ ID NO: 827950

SEQ ID NO: 827953 - protein, 1009 aa, Homo sapiens; identical to SEQ ID NO: 827950

SEQ ID NO: 827954 - protein, 1009 aa, Homo sapiens; identical to SEQ ID NO: 827950

SEQ ID NO: 827955 - protein, 538 aa, Homo sapiens
MSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQVPEGLCASSPTLTSPMEYPSPVNSLHTPPLHRHNVFKRHSMREEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 827956 - protein, 292 aa, Homo sapiens
LELQLWSQEVGLRRGSVLKVQVPEGLCASSPTLTSPMEYPSPVNSLHTPPLHRHNVFKRHSMREEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 827957 - protein, 256 aa, Homo sapiens [sequence omitted]

SEQ ID NO: 827958 - protein, 125 aa, Homo sapiens
MELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 827959 - protein, 170 aa, Homo sapiens
MIRPIDAEKKSVIEIKGPKKPEVGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 827960 - protein, 91 aa, Homo sapiens
GWVRGLGVDPAFLPSSSRTEIEGTQKLLNKDLAELINKMRLAQQNAVTSLSEECKRQMLTASHTLAVDAKNLLDAVDQAKVLANLAHPPAE

SEQ ID NO: 827961 - protein, 892 aa, Homo sapiens
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQVPEGLCASSPTLTSPMEYPSPVNSLHTPPLHRHNVFKRHSMREEDFIQPSSREEAQQLWEAEKVKMRQILDKQQKQMVEDYQWLRQEEKSLDPMVYMNDKSPLTPEKEVGYRECSRPSSGGFLLAPCAEPPSLPTAQGREQRSLSAFPAASAMI

SEQ ID NO: 827962 - protein, 548 aa, Homo sapiens
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHR

SEQ ID NO: 827963 - protein, 448 aa, Homo sapiens
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVAPPNQGKKEECWTGGPWSQMARG

SEQ ID NO: 827964 - protein, 212 aa, Homo sapiens; identical to SEQ ID NO: 827944

SEQ ID NO: 827965 - protein, 105 aa, Homo sapiens
MSGVSEPLSRVKLGTLRRPEGPAEPMVVVPVDVEKEDVRILKVCFYSNSFNPGKNFKLVKCTVQTEIRAKCHLLIANAEGLKPLRLLAKSCSILTGCVAWDLMIN

SEQ ID NO: 827966 - protein, 116 aa, Homo sapiens
QLWEAEKVKMRQILDKQQKQMVEDYQWLRQEEKSLVSTPGRMSVPCTHLCPLPPPQVAGARVPCILGAFSSRILSPSLLFLPLQDPMVYMNDKSPLVSCQERPPPPCQGLGRPRPP

SEQ ID NO: 827967 - protein, 130 aa, Homo sapiens
MSALWLLLGLLALMDLSESSNWGCYGNIQSLDTPGASCGIGRRHGLNYCGVRASERLAEIDMPYLLKYQPMMQTIGQKYCMDPAVIAGVLSRKSPGDKILVNMGDRTSMVQDPGSQAGGEHSNQKKKVFP

SEQ ID NO: 827968 - protein, 194 aa, Homo sapiens
MSALWLLLGLLALMDLSESSNWGCYGNIQSLDTPGASCGIGRRHGLNYCGVRASERLAEIDMPYLLKYQPMMQTIGQKYCMDPAVIAGVLSRKSPGDKILVNMGDRTSMVQDPGSQAPTSWISESQVSQTTEVLTTRIKEIQRRFPTWTPDQYLRGGLCAYSGGAGYVRSSQDLSCDFCNDVLARAKYLKRHGF

SEQ ID NO: 827969 - protein, 194 aa, Homo sapiens; identical to SEQ ID NO: 827968

SEQ ID NO: 827970 - protein, 192 aa, Homo sapiens
RPALRYPERLKKLHNLKTEGYRKQQQRQQQQQQQQKKVKTPIKKQEAKKKAKSDPGIQSTSHKHPVTTVHDRLYGYRTLPGQNSDMKQQQQMEKGTTSKQDSTERPKMNYYDHADFHHSVKSPELYETEPTNKDISAPVDAVPEAQAARQKKISFNFSEIMASTGWNSELKLLRILQDTDDEDEEDQSSGAE

SEQ ID NO: 827971 - protein, 349 aa, Homo sapiens
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 827972 - protein, 349 aa, Homo sapiens; identical to SEQ ID NO: 827971

SEQ ID NO: 827973 - protein, 349 aa, Homo sapiens; identical to SEQ ID NO: 827971

SEQ ID NO: 827974 - protein, 397 aa, Homo sapiens
RGRSGRAQGRLKRPGKLACRKFPGRRQRVVPEKKEILFLEHLLVVPSEMSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 827975 - protein, 331 aa, Homo sapiens
MSSLSGKVQTVLGLVEPSKLGRTLTHEHLAMTFDCCYCPPPPCQEAISKEPIVMKNLYWIQKNAYSHKVKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 827976 - protein, 200 aa, Homo sapiens
MNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 827977 - protein, 144 aa, Homo sapiens
MAEEEILPKQGSVYNTRENEGTIPGESKRDALESWPQHGLMHTGTYGPPIGISELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 827978 - protein, 233 aa, Homo sapiens
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDR

SEQ ID NO: 827979 - protein, 152 aa, Homo sapiens
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQNSIPSGPA

SEQ ID NO: 827980 - protein, 140 aa, Homo sapiens
EVPREKAARCTRGKASWSQSRSRNCGPSRKSGARRRRPRGQGSLQSSTRGSCRKEGFSSRCAWALPPLLKCLRDVAKSASPVWRQLPVARQQCPGASSGSCAKPPLISFFFFFFLDSGSGSASQARVHLARSQLTAASTS

SEQ ID NO: 827981 - protein, 349 aa, Homo sapiens; identical to SEQ ID NO: 827971

SEQ ID NO: 827982 - protein, 349 aa, Homo sapiens; identical to SEQ ID NO: 827971

SEQ ID NO: 827983 - protein, 349 aa, Homo sapiens; identical to SEQ ID NO: 827971

SEQ ID NO: 827984 - protein, 349 aa, Homo sapiens; identical to SEQ ID NO: 827971

SEQ ID NO: 827985 - protein, 331 aa, Homo sapiens
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 827986 - protein, 200 aa, Homo sapiens; identical to SEQ ID NO: 827976

SEQ ID NO: 827987 - protein, 443 aa, Homo sapiens
MAASPHTLSSRLLTGCVGGSVWYLERRTIQDSPHKFLHLLRNVNKQWITFQHFSFLKRMYVTQLNRSHNQQVRPKPEPVASPFLEKTSSGQAKAEIYEMRPLSPPSLSLSRKPNEKELIELEPDSVIEDSIDVGKETKEEKRWKEMKLQVYDLPGILARLSKIKLTALVVSTTAAGFALAPGPFDWPCFLLTSVGTGLASCAANSINQFFEVPFDSNMNRTKNRPLVRGQISPLLAVSFATCCAVPGVAILTLGVNPLTGALGLFNIFLYTCCYTPLKRISIANTWVGAVVGAIPPVMGWTAATGSLDAGAFLLGGILYSWQFPHFNALSWGLREDYSRGGYCMMSVTHPGLCRRVALRHCLALLVLSAAAPVLDITTWTFPIMALPINAYISYLGFRFYVDADRRSSRRLFFCSLWHLPLLLLLMLTCKRPSGGGDAGPPPS

SEQ ID NO: 827988 - protein, 171 aa, Homo sapiens
MAASPHTLSSRLLTGCVGGSVWYLERRTIQDSPHKFLHLLRNVNKQWITFQHFSFLKRMYVTQLNRSHNQQVRPKPEPVASPFLEKTSSGQAKAEIYEMRPLSPPSLSLSRKPNEKELIELEPDSVIEDSIDVGKETKEEKRWKEMKLQVYDLPGILARLSKIKLTGTLFF

SEQ ID NO: 827989 - protein, 443 aa, Homo sapiens; identical to SEQ ID NO: 827987

SEQ ID NO: 827990 - protein, 345 aa, Homo sapiens [sequence omitted]

SEQ ID NO: 827991 - protein, 85 aa, Homo sapiens
MEQASCWEKEEQEILSTRANSRQSPAKVQSKNKYLHSPESRPVTGERGQLLELSKESSEEEEEEEDEGGQGGYTETGILLRVEQP

SEQ ID NO: 827992 - protein, 2073 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATGTTQKLKPPPSSLPPPTPISGQSPSSQKSSTATSSPSPQSSSSQCSVPSLSSLTTNSQLKALFDGLSHTIPLRDSLAKRDTPSYAPPKRMRRKTELSSTAKSKAHFFGKRDIRSRFISHSSSSSWGMARGSIFKAIAHFKRTTFLKKHRMLGRLKYKVTPQMGTPSPGKGSLTDGRIKPDQDDDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYLSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 827993 - protein, 1781 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYLSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 827994 - protein, 1890 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYLSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 827995 - protein, 1781 aa, Homo sapiens; identical to SEQ ID NO: 827993

SEQ ID NO: 827996 - protein, 1439 aa, Homo sapiens
TITLRGIINPTPSPGKGSLTDGRIKPDQDDDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYLSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 827997 - protein, 1064 aa, Homo sapiens
MRSKASSCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 827998 - protein, 2038 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATGTTQKLKPPPSSLPPPTPISGQSPSSQKSSTATSSPSPQSSSSQCSVPSLSSLTTNSQLKALFDGLSHTIPLRDSLAKRDTPSYAPPKRMRRKTELSSTAKSKAHFFGKRDIRSRFISHSSSSSWGMARGSIFKAIAHFKRTTFLKKHRMLGRLKYKVTPQMGTPSPGKGSLTDGRIKPDQDDDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYLSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNRHLCHQPLPPISHKSMGAPRPYHAGSRTDFNDAERHEHECEPMPSQPPVGP

SEQ ID NO: 827999 - protein, 1030 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATGTTQKLKPPPSSLPPPTPISGQSPSSQKSSTATSSPSPQSSSSQCSVPSLSSLTTNSQLKALFDGLSHTIPLRDSLAKRDTPSYAPPKRMRRKTELSSTAKSKAHFFGKRDIRSRFISHSSSSSWGMARGSIFKAIAHFKRTTFLKKHRMLGRLKYKVTPQMGTPSPGKGSLTDGRIKPDQDDDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYLSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASYEKEKPSIRVILGK

SEQ ID NO: 828000 - protein, 202 aa, Homo sapiens
PSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQVSEGVMFVHSHYCPFVFYGFT

SEQ ID NO: 828001 - protein, 1276 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATGTTQKLKPPPSSLPPPTPISGQSPSSQKSSTATSSPSPQSSSSQCSVPSLSSLTTNSQLKALFDGLSHTIPLRDSLAKRDTPSYAPPKRMRRKTELSSTAKSKAHFFGKRDIRSRFISHSSSSSWGMARGSIFKAIAHFKRTTFLKKHRMLGRLKYKVTPQMGTPSPGKGSLTDGRIKPDQDDDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYLSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNFGSLFDLENDLPDELIPNGGELGLLNSGNLVPDAASKHKQLSELLRGGSGSSIN

SEQ ID NO: 828002 - protein, 182 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNADGRPVQSSIR

SEQ ID NO: 828003 - protein, 832 aa, Homo sapiens [sequence omitted]

SEQ ID NO: 828004 - protein, 832 aa, Homo sapiens [sequence omitted]

SEQ ID NO: 828005 - protein, 953 aa, Homo sapiens
QCTPGKRKTSISSPRSAAVFAACASRRLGTQSPWRATGRNLEPVERTRNLDPRRSRRQYRFLSGGRSLTLSFRLECSGATSAHCNICLPGSSNSPASPSRVAGIQTAAVRMSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828006 - protein, 697 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLVLLVLLYLQLPRVLRRSEKFNFLALVLPIVLVSLIL

SEQ ID NO: 828007 - protein, 820 aa, Homo sapiens
WGENQIPVRGHLAHWSIHELNFNSPFNHLISPLCFFIQGFFIVISDSFWPCIPIEAFFFAFPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828008 - protein, 832 aa, Homo sapiens [sequence omitted]

SEQ ID NO: 828009 - protein, 577 aa, Homo sapiens
GHIGVLRLSLSSRIIKLRDSQYEKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828010 - protein, 564 aa, Homo sapiens
RRLLHGLHVRKRHLHRPMKMPFSQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828011 - protein, 339 aa, Homo sapiens [sequence omitted]

SEQ ID NO: 828012 - protein, 667 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEDAYERRKLERKLREKEAAYQERLKTWEIRERKKTREYEKEAEREEDRRREMAKEAKRLKEFLEDHNKYRVDASTLNLLCKYKPNCHGLLS

SEQ ID NO: 828013 - protein, 609 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYSREGLQKRLRDRERENESENENGSERESERGNGSEKEKKTKNGTEKKMKKMHTNEENLKENSERKKLLIKSALRLGKSENERKPGNMRKKLKEKKTEEEKWPKKLND

SEQ ID NO: 828014 - protein, 482 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKGS

SEQ ID NO: 828015 - protein, 465 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIREHIKKIIIK

SEQ ID NO: 828016 - protein, 348 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKEREQFGSLQKTRTHGPNNYS

SEQ ID NO: 828017 - protein, 283 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKRSYGD

SEQ ID NO: 828018 - protein, 167 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQNAVSTAAVGN

SEQ ID NO: 828019 - protein, 832 aa, Homo sapiens [sequence omitted]

SEQ ID NO: 828020 - protein, 832 aa, Homo sapiens [sequence omitted]

SEQ ID NO: 828021 - protein, 699 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLVLLVLLYLQLPRVLRRSEKFNFLALVSSELFFTVGIFL

SEQ ID NO: 828022 - protein, 591 aa, Homo sapiens
MYQWFGVFVPSTGLCAGKNLNTGATELTLKVLLLVSRKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828023 - protein, 638 aa, Homo sapiens
MIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828024 - protein, 596 aa, Homo sapiens
REREREKDKKRDREEDEEDAYERRKLERKLREKEAAYQERLKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828025 - protein, 505 aa, Homo sapiens
MNNFNENTSHKLLPPPLITKEDINAIEMEEDKRDLISREISKFRDTHKKLEEEKGKKEKERQEIEKERREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828026 - protein, 386 aa, Homo sapiens
MSGSEKSVYTKKGRVIFITCMLILYIVLISSKAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828027 - protein, 501 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRHIPLL

SEQ ID NO: 828028 - protein, 175 aa, Homo sapiens
MVGYGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 828029 - protein, 419 aa, Homo sapiens
MGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERRTFSADFQWPQLIPYPLITKEDINAIEMEEDKRDLISREISKFRDTHKKLEEEKGKK

SEQ ID NO: 828030 - protein, 283 aa, Homo sapiens; identical to SEQ ID NO: 828017

SEQ ID NO: 828031 - protein, 289 aa, Homo sapiens [sequence omitted]

SEQ ID NO: 828032 - protein, 145 aa, Homo sapiens
SARRARGRPPSARRAARLYLRPVRVGAWALSLPGERRAEISNQWSALVTWIPEGREGSTVSSAADCCSKNVFSTSFESPSHGNPSTPTRDPTPAVSRISSTCTSRDPNDSCTNEHYGSCSNCLSTHCVYGWKAFGRKKGSSRLKG

SEQ ID NO: 828033 - protein, 403 aa, Homo sapiens [sequence omitted]

SEQ ID NO: 828034 - protein, 403 aa, Homo sapiens [sequence omitted]

SEQ ID NO: 828035 - protein, 403 aa, Homo sapiens [sequence omitted]

SEQ ID NO: 828036 - protein, 403 aa, Homo sapiens [sequence omitted]

SEQ ID NO: 828037 - protein, 387 aa, Homo sapiens
MTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 828038 - protein, 172 aa, Homo sapiens
MTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKILSLWSAS

SEQ ID NO: 828039 - protein, 403 aa, Homo sapiens [sequence omitted]

SEQ ID NO: 828040 - protein, 403 aa, Homo sapiens [sequence omitted]

SEQ ID NO: 828041 - protein, 403 aa, Homo sapiens [sequence omitted]

SEQ ID NO: 828042 - protein, 369 aa, Homo sapiens
MGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 828043 - protein, 344 aa, Homo sapiens
MTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVS

SEQ ID NO: 828044 - protein, 196 aa, Homo sapiens
MTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGKLFFDVFPFLFLDLRIYWKTDFGFLFFLQFY

SEQ ID NO: 828045 - protein, 105 aa, Homo sapiens
MTAIIKEIVSRNKRRYQEDGFDLDLTYIYPNIIAMGFPAERLEGVYRNNIDDVVRKECFDFLFQILMFIFMLCFHLEKISKPQKKILCDVTIIVVLYNHFLAYRT

SEQ ID NO: 828046 - protein, 403 aa, Homo sapiens [sequence omitted]

SEQ ID NO: 828047 - protein, 403 aa, Homo sapiens [sequence omitted]

SEQ ID NO: 828048 - protein, 403 aa, Homo sapiens [sequence omitted]

SEQ ID NO: 828049 - protein, 371 aa, Homo sapiens
MLLLKSVMIAFRKISKLLFQSKKFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 828050 - protein, 403 aa, Homo sapiens [sequence omitted]

SEQ ID NO: 828051 - protein, 347 aa, Homo sapiens
MTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKGQGLTMLPRLVSNSWAQAVLTLWHPKELELQDKCFTFWEIHSSYPDQRKLRKVEMEVMCQNPCLADKAAIMQGFYSYLQK

SEQ ID NO: 828052 - protein, 282 aa, Homo sapiens
SGRIYKREPGLFLVVPPGLLAGEGVCQLLRHSSPGRCLLKSRARGSVIMSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQIPVEVKIKIQVYFTTKKQPIKVQISISKKKSFPIRKSSQKCKS

SEQ ID NO: 828053 - protein, 282 aa, Homo sapiens; identical to SEQ ID NO: 828052

SEQ ID NO: 828054 - protein, 304 aa, Homo sapiens
SGRIYKREPGLFLVVPPGLLAGEGVCQLLRHSSPGRCLLKSRARGSVIMSRYGRYGGETKVYVGNLGTGAGKGELERAFSYYGPLRTVWIEKGHYAYDCHRYSRRRRSRSRSRSHSRSRGRRYSRSRSRSRGRRSRSASPRRSRSISLRRSRSASLRRSRSGSIKGSRYFQQPVEVKIKIQLLRPRSSRSSPDSFKSVQESRCFRALGALPYGLVISQPRQGMKDCYKECEEEWGPREAGGVLTHLWFLVRWNRYYPIHRKPLSTRRLRKRKILRLARTTGVGVCWEKVLGRSGSIGRGVSDPL

SEQ ID NO: 828055 - protein, 282 aa, Homo sapiens; identical to SEQ ID NO: 828052

SEQ ID NO: 828056 - protein, 282 aa, Homo sapiens; identical to SEQ ID NO: 828052

SEQ ID NO: 828057 - protein, 271 aa, Homo sapiens
SGRIYKREPGLFLVVPPGLLAGEGVCQLLRHSSPGRCLLKSRARGSVIMSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQIPVEVKIKIQVYFTTKKQPIKVQISISKKKVS

SEQ ID NO: 828058 - protein, 210 aa, Homo sapiens
SGRIYKREPGLFLVVPPGLLAGEGVCQLLRHSSPGRCLLKSRARGSVIMSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRGIYFNKGMVGILVNQVILLLARQKLVFFYKLEC

SEQ ID NO: 828059 - protein, 270 aa, Homo sapiens
SGRIYKREPGLFLVVPPGLLAGEGVCQLLRHSSPGRCLLKSRARGSVIMSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQIPVEVKIKIQVYFTTKKQSFPIRKSSQKCKS

SEQ ID NO: 828060 - protein, 185 aa, Homo sapiens
SGRIYKREPGLFLVVPPGLLAGEGVCQLLRHSSPGRCLLKSRARGSVIMSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRFLRLSQSP

SEQ ID NO: 828061 - protein, 210 aa, Homo sapiens; identical to SEQ ID NO: 828058

SEQ ID NO: 828062 - protein, 170 aa, Homo sapiens
SGRIYKREPGLFLVVPPGLLAGEGVCQLLRHSSPGRCLLKSRARGSVIMSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEVFILIKEWLVF

SEQ ID NO: 828063 - protein, 210 aa, Homo sapiens; identical to SEQ ID NO: 828058

SEQ ID NO: 828064 - protein, 117 aa, Homo sapiens
MGQRGSTCKLARSRSRSHSRSRGRRYSRSRSRSRGRRSRSASPRRSRSISLRRSRSASLRRSRSGSIKGSRYFQIPVEVKIKIQVYFTTKKQPIKVQISISKKKSFPIRKSSQKCKS

SEQ ID NO: 828065 - protein, 116 aa, Homo sapiens
LLLLNSRPRRRSRSRSHSRSRGRRYSRSRSRSRGRRSRSASPRRSRSISLRRSRSASLRRSRSGSIKGSRYFQIPVEVKIKIQVYFTTKKQPIKVQISISKKKSFPIRKSSQKCKS

SEQ ID NO: 828066 - protein, 271 aa, Homo sapiens; identical to SEQ ID NO: 828057

SEQ ID NO: 828067 - protein, 270 aa, Homo sapiens; identical to SEQ ID NO: 828059

SEQ ID NO: 828068 - protein, 113 aa, Homo sapiens [sequence omitted]

SEQ ID NO: 828069 - protein, 210 aa, Homo sapiens; identical to SEQ ID NO: 828058

SEQ ID NO: 828070 - protein, 287 aa, Homo sapiens
SGRIYKREPGLFLVVPPGLLAGEGVCQLLRHSSPGRCLLKSRARGSVIMSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQIPVEVKIKIQVYFTTKKQRSTVPDSPSPKRSRSPSGSPRRSASPERMD

SEQ ID NO: 828071 - protein, 210 aa, Homo sapiens; identical to SEQ ID NO: 828058

SEQ ID NO: 828072 - protein, 145 aa, Homo sapiens
SGRIYKREPGLFLVVPPGLLAGEGVCQLLRHSSPGRCLLKSRARGSVIMSRYGRYGGETKVYVGNLGTGAGKGELERAFSYYGPLRTVWIARNPPGFAFVEFEDPRDAEDAVRGLDGKYLSLTQQEQGRKVKVSISSTIKIYLSS

SEQ ID NO: 828073 - protein, 538 aa, Homo sapiens
ISQEAVQSEMGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSSHSSSSSSFQFSSSSFQVGNGSALPTNDNSYRGILNPSQPGQSSSSSQTSGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGSPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLDSP

SEQ ID NO: 828074 - protein, 108 aa, Homo sapiens
MPLGFRSQFHPTLHYRAHHALLDHRPQHTHCLSRPLSQPLPVAISLSAQMIPWVRETLGHPQRLEQAPCCPWILDRWLSKLWGLGADFLPSWSPGSPLRVWVVLFLRL

SEQ ID NO: 828075 - protein, 156 aa, Homo sapiens
KFSTPTTPSAATFQCFGFWASYHISSSLTPPTSSRTSTFSFECSSNCTTVSLTSYTSYHFGTGTPAPAFWNRATLSITCHRSSSPAPRTKQYSNTYCFRVLSSSWLCGPATWGSRTSAGISSAWTDSNSQSTGATNISKQLPWVRVALKWTPKTFF

SEQ ID NO: 828076 - protein, 156 aa, Homo sapiens; identical to SEQ ID NO: 828075

SEQ ID NO: 828077 - protein, 156 aa, Homo sapiens; identical to SEQ ID NO: 828075

SEQ ID NO: 828078 - protein, 156 aa, Homo sapiens; identical to SEQ ID NO: 828075

SEQ ID NO: 828079 - protein, 102 aa, Homo sapiens
MSSPPEGKLETKAGHPPAVKAGGMRIVQKHPHTGDTKEEKDKDDQEWESPSPPKPTVFISGVIARGDKDFPPAAAQVAHQKPHASMDKHPSPRTQHIQQPRK

SEQ ID NO: 828080 - protein, 102 aa, Homo sapiens; identical to SEQ ID NO: 828079

SEQ ID NO: 828081 - protein, 102 aa, Homo sapiens; identical to SEQ ID NO: 828079

SEQ ID NO: 828082 - protein, 108 aa, Homo sapiens
MSSPPEGKLETKAGHPPAVKAGGMRIVQKHPHTGDTKEEKDKDDQEWESPSPPKPTVFISGVIARGDKDFPPAAAQVAHQKPHASMDKHPSPRTQHIQQPRKSQHAKE

SEQ ID NO: 828083 - protein, 102 aa, Homo sapiens; identical to SEQ ID NO: 828079

SEQ ID NO: 828084 - protein, 102 aa, Homo sapiens; identical to SEQ ID NO: 828079

SEQ ID NO: 828085 - protein, 102 aa, Homo sapiens; identical to SEQ ID NO: 828079

SEQ ID NO: 828086 - protein, 102 aa, Homo sapiens; identical to SEQ ID NO: 828079

SEQ ID NO: 828087 - protein, 102 aa, Homo sapiens; identical to SEQ ID NO: 828079

SEQ ID NO: 828088 - protein, 33 aa, Homo sapiens
MFSKNPIRLNINICSLFYDSDNSWAMWGPVLCI

SEQ ID NO: 828089 - protein, 102 aa, Homo sapiens; identical to SEQ ID NO: 828079

SEQ ID NO: 828090 - protein, 102 aa, Homo sapiens; identical to SEQ ID NO: 828079

SEQ ID NO: 828091 - protein, 156 aa, Homo sapiens
LVEAGVYSARLTTVFISGVIARGDKDFPPAAAQVAHQKPHASMDKHPAPWPRLCCTWYFPDRENQQFRPNPTLLGNLRQNQVLCPLPYISIFKTRNSSSPNLVYGESGWMSFEDHCAPRGAISRICQDPRKILALVLFQQSPDVLVYGLKNKKAHI

SEQ ID NO: 828092 - protein, 102 aa, Homo sapiens; identical to SEQ ID NO: 828079

SEQ ID NO: 828093 - protein, 102 aa, Homo sapiens; identical to SEQ ID NO: 828079

SEQ ID NO: 828094 - protein, 102 aa, Homo sapiens; identical to SEQ ID NO: 828079

SEQ ID NO: 828095 - protein, 102 aa, Homo sapiens; identical to SEQ ID NO: 828079

SEQ ID NO: 828096 - protein, 102 aa, Homo sapiens; identical to SEQ ID NO: 828079

SEQ ID NO: 828097 - protein, 102 aa, Homo sapiens; identical to SEQ ID NO: 828079

SEQ ID NO: 828098 - protein, 167 aa, Homo sapiens
SHTYPMLPAGTLVGAGLGLPHPQTPCFLQGHWWVLAWGFLTHKHHASCRDTGGCWPGGSSPTNTMLPAGTLMGAGLDVPHIQPPCFLQGRWWALAWGFLTYKPHASCRGAGGPWPGASSHTNPMLPTGTLVDAGLRLPHTQLLSFRRDAGGHWPGASSPTNPMLPID

SEQ ID NO: 828099 - protein, 549 aa, Homo sapiens
MAAQLLTDEALESVTFRDVTVDFTQEEWQQLEPAQKDLYRDVMLENYRNLVSLDWETRPEMKELDPKNDISEDKLSVVGEATGGPTRNGARGPGSEGVWEPGSWPERPRGDAGAEWEPLGIPQGNKLLGGSVPACHELKAFANQGCVLVPPRLDDPTEKGACPPVRRGKNFSSTSDLSKPPMPCEEKKTYDCSECGKAFSRSSSLIKHQRIHTGEKPFECDTCGKHFIERSSLTIHQRVHTGEKPYACGDCGKAFSQRMNLTVHQRTHTGEKPYVCDVCGKAFRKTSSLTQHERIHTGEKPYACGDCGKAFSQNMHLIVHQRTHTGEKPYVCPECGRAFSQNMHLTEHQRTHTGEKPYACKECGKAFNKSSSLTLHQRNHTGEKPYVCGECGKAFSQSSYLIQHQRFHIGVKPFECSECGKAFSKNSSLTQHQRIHTGEKPYECYICKKHFTGRSSLIVHQIVHTGEKPYVCGECGKAFSQSAYLIEHQRIHTGEKPYRCGQCGKSFIKNSSLTVHQRIHTGEKPYRCGECGKTFSRNTNLTRHLRIHT

SEQ ID NO: 828100 - protein, 489 aa, Homo sapiens
MKELDPKNDISEDKLSVVGEATGGPTRNGARGPGSEGVWEPGSWPERPRGDAGAEWEPLGIPQGNKLLGGSVPACHELKAFANQGCVLVPPRLDDPTEKGACPPVRRGKNFSSTSDLSKPPMPCEEKKTYDCSECGKAFSRSSSLIKHQRIHTGEKPFECDTCGKHFIERSSLTIHQRVHTGEKPYACGDCGKAFSQRMNLTVHQRTHTGEKPYVCDVCGKAFRKTSSLTQHERIHTGEKPYACGDCGKAFSQNMHLIVHQRTHTGEKPYVCPECGRAFSQNMHLTEHQRTHTGEKPYACKECGKAFNKSSSLTLHQRNHTGEKPYVCGECGKAFSQSSYLIQHQRFHIGVKPFECSECGKAFSKNSSLTQHQRIHTGEKPYECYICKKHFTGRSSLIVHQIVHTGEKPYVCGECGKAFSQSAYLIEHQRIHTGEKPYRCGQCGKSFIKNSSLTVHQRIHTGEKPYRCGECGKTFSRNTNLTRHLRIHT

SEQ ID NO: 828101 - protein, 125 aa, Homo sapiens
SHSNANPSRLLTTPSWTLTPVISLNPPPLQYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 828102 - protein, 728 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 828103 - protein, 728 aa, Homo sapiens; identical to SEQ ID NO: 828102

SEQ ID NO: 828104 - protein, 702 aa, Homo sapiens
MAGFWVGTAPLVAAGRRGRWPPQQLMLSAALRTLKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 828105 - protein, 710 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSADTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 828106 - protein, 543 aa, Homo sapiens
MPHGINVESHFLLLQDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 828107 - protein, 324 aa, Homo sapiens
MGAGGLFSVRCAVAVTVLVSLNFEVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 828108 - protein, 301 aa, Homo sapiens
NISLCPEICFQKIESQVYFVRVDSGIQPGSDISIYYDPMISKLITYGSDRTEALKRMADALDNYVIRGVTHNIALLREVIINSRFVRHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 828109 - protein, 128 aa, Homo sapiens
WVIPVLQPSEITLLSCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 828110 - protein, 744 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAATSSLSVEICLFWTFQVAEGQEICVIEAMKMQNSMTAGKTGTVKSVHCQAGDTVGEGDLLVELE

SEQ ID NO: 828111 - protein, 681 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVVAEGQEICVIEAMKMQNSMTAGKTGTVKSVHCQAGDTVGEGDLLVELE

SEQ ID NO: 828112 - protein, 728 aa, Homo sapiens; identical to SEQ ID NO: 828102

SEQ ID NO: 828113 - protein, 728 aa, Homo sapiens; identical to SEQ ID NO: 828102

SEQ ID NO: 828114 - protein, 728 aa, Homo sapiens; identical to SEQ ID NO: 828102

SEQ ID NO: 828115 - protein, 728 aa, Homo sapiens; identical to SEQ ID NO: 828102

SEQ ID NO: 828116 - protein, 728 aa, Homo sapiens; identical to SEQ ID NO: 828102

SEQ ID NO: 828117 - protein, 728 aa, Homo sapiens; identical to SEQ ID NO: 828102

SEQ ID NO: 828118 - protein, 728 aa, Homo sapiens; identical to SEQ ID NO: 828102

SEQ ID NO: 828119 - protein, 728 aa, Homo sapiens; identical to SEQ ID NO: 828102

SEQ ID NO: 828120 - protein, 728 aa, Homo sapiens; identical to SEQ ID NO: 828102

SEQ ID NO: 828121 - protein, 776 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSHKTAHSLTPPSHNNLPTEPPQPPRPTTQSLLPTTPFFIHRNYNTSIIFHSPPPTPHNTPPTPPPTPLHSTPTQHPKITSPPAHHPPHPRTHHTPYNHPTTSH

SEQ ID NO: 828122 - protein, 640 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVPWRKLLD

SEQ ID NO: 828123 - protein, 640 aa, Homo sapiens; identical to SEQ ID NO: 828122

SEQ ID NO: 828124 - protein, 642 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLSMDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAEMLYSGGCRLLSPG

SEQ ID NO: 828125 - protein, 644 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLSMDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLPREEVEHEHLVSWTVSKVNILTRLGEDFTKLFLEWAAFFLETR

SEQ ID NO: 828126 - protein, 519 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKAHANQE

SEQ ID NO: 828127 - protein, 576 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMLLLTRHSTGALSIVEGDGSKLVPAVAW

SEQ ID NO: 828128 - protein, 202 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSADTHAIQAMGDKIESKLLAKKAEVNTIPGFDGVVKDAEEAVRIARVGYPVMIGLS

SEQ ID NO: 828129 - protein, 86 aa, Homo sapiens
SVTFSSINLFDSAASLVKIFTLYTVTKKLNAHVSTCFSRKTLDSVLRSPMPGVVVAVSVKPGDAVRAVCVSLQDMLVSNFPFQSDG

SEQ ID NO: 828130 - protein, 2409 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 828131 - protein, 3396 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 828132 - protein, 2409 aa, Homo sapiens; identical to SEQ ID NO: 828130

SEQ ID NO: 828133 - protein, 2409 aa, Homo sapiens; identical to SEQ ID NO: 828130

SEQ ID NO: 828134 - protein, 2409 aa, Homo sapiens; identical to SEQ ID NO: 828130

SEQ ID NO: 828135 - protein, 2409 aa, Homo sapiens; identical to SEQ ID NO: 828130

SEQ ID NO: 828136 - protein, 2171 aa, Homo sapiens
SPFSTGVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 828137 - protein, 1642 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 828138 - protein, 3370 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNRKWSFRKNGLPCYNNY

SEQ ID NO: 828139 - protein, 3379 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 828140 - protein, 655 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 828141 - protein, 302 aa, Homo sapiens
MNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 828142 - protein, 2920 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLELFFAAFLFLHLQERPEWRTFL

SEQ ID NO: 828143 - protein, 3396 aa, Homo sapiens; identical to SEQ ID NO: 828131

SEQ ID NO: 828144 - protein, 3378 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSVAALRVPS

SEQ ID NO: 828145 - protein, 2688 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTEQLPSNQLI

SEQ ID NO: 828146 - protein, 2524 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYEREGCREEGWYE

SEQ ID NO: 828147 - protein, 1784 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPGMPARSRYARRSRYAKKVTGMPEVT

SEQ ID NO: 828148 - protein, 214 aa, Homo sapiens
ASVAGGRKMAAAVLGQLGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 828149 - protein, 126 aa, Homo sapiens
MWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 828150 - protein, 86 aa, Homo sapiens
RFRTFDPPEEGYLPLEPESTSGRGQCLKRIRYHGRGRFGIMEKVYCHYFVKLVEGPPPPPEPPKTAVAHAKEYIQQLRSRTIVHTL

SEQ ID NO: 828151 - protein, 84 aa, Homo sapiens
APFVRPEEERLSLAPESTSGRGQCLKRIRYHGRGRFGIMEKVYCHYFVKLVEGPPPPPEPPKTAVAHAKEYIQQLRSRTIVHTL

SEQ ID NO: 828152 - protein, 84 aa, Homo sapiens
PSRSTPRERKPFTEPESTSGRGQCLKRIRYHGRGRFGIMEKVYCHYFVKLVEGPPPPPEPPKTAVAHAKEYIQQLRSRTIVHTL

SEQ ID NO: 828153 - protein, 175 aa, Homo sapiens
MAGGSRAFYFGGSTGTVGGVMDTKPEEPPQAGLGEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 828154 - protein, 214 aa, Homo sapiens; identical to SEQ ID NO: 828148

SEQ ID NO: 828155 - protein, 214 aa, Homo sapiens; identical to SEQ ID NO: 828148

SEQ ID NO: 828156 - protein, 214 aa, Homo sapiens; identical to SEQ ID NO: 828148

SEQ ID NO: 828157 - protein, 88 aa, Homo sapiens
DIEIYNKTRASPDPPHSIAESTSGRGQCLKRIRYHGRGRFGIMEKVYCHYFVKLVEGPPPPPEPPKTAVAHAKEYIQQLRSRTIVHTL

SEQ ID NO: 828158 - protein, 203 aa, Homo sapiens
ASVAGGRKMAAAVLGQLGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIS

SEQ ID NO: 828159 - protein, 214 aa, Homo sapiens; identical to SEQ ID NO: 828148

SEQ ID NO: 828160 - protein, 86 aa, Homo sapiens
LVTPLTAYASSLTRITPESTSGRGQCLKRIRYHGRGRFGIMEKVYCHYFVKLVEGPPPPPEPPKTAVAHAKEYIQQLRSRTIVHTL

SEQ ID NO: 828161 - protein, 87 aa, Homo sapiens
LFPSCPREKESSLDPLLTESTSGRGQCLKRIRYHGRGRFGIMEKVYCHYFVKLVEGPPPPPEPPKTAVAHAKEYIQQLRSRTIVHTL

SEQ ID NO: 828162 - protein, 78 aa, Homo sapiens
PPYTESYDAESTSGRGQCLKRIRYHGRGRFGIMEKVYCHYFVKLVEGPPPPPEPPKTAVAHAKEYIQQLRSRTIVHTL

SEQ ID NO: 828163 - protein, 178 aa, Homo sapiens
MPKGPFPVNWFIHQGLVHPVWDLMAVNFIFPLGQGIYEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 828164 - protein, 354 aa, Homo sapiens
VPEVKKEETLLDLDFDPFKPEVTPAGSAGVTHSPMSQTLPWDLWTTSTDLVQPASGGSFNGFTQPQDTSLFTMQTDQSMICNLAESEQAPPTEPKAEEPLAAVTPAVGLDLGMDTRAEEPVEEAVIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 828165 - protein, 260 aa, Homo sapiens
SPFKTLSPIPYPSSQFPPKPHAYQTAWLFKDPEINSTKGLGLRRNRRRLCGTAEGPDLSLAVGKYGSGSPSFGLGAKAGCAGQGGSVFQALPASPRFFFPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 828166 - protein, 207 aa, Homo sapiens
VPEVKKEETLLDLDFDPFKPEVTPAGSAGVTHSPMSQTLPWDLWTTSTDLVQPASGGSFNGFTQPQDTSLFTMQTDQSMICNLAESEQAPPTEPKAEEPLAAVTPAVGLDLGMDTRAEEPVEEAVIIPGADADAAVGTLVSAAEGAPGEEAEAEKATVPAGEGVSLEEAKIGTETTEGAESAQPEAEELSRTLSPRLLHQPWGLLTS

SEQ ID NO: 828167 - protein, 902 aa, Homo sapiens
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKDGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 828168 - protein, 148 aa, Homo sapiens
VNKRWIASNSRMKSSGLRVRAITGKCPSQFRTTAQFMLQTNVVGPSFHLCSRVRCMQETFYMEKACMSPNVQFITAALCHLHTLDSFLPTSLMCLSTDTVFTSPVTSTSKQMFCGKVTKHLCHFLKLIKFSLGRSLVPLALKDIIAEK

SEQ ID NO: 828169 - protein, 949 aa, Homo sapiens
AAAGVPAGAGMGRAGAAANGTPQNVQGITSYQQRITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKVCAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 828170 - protein, 919 aa, Homo sapiens
AAAGVPAGAGMGRAGAAANGTPQNVQGITSYQQRLQALRKEKSRDAARSRRGKENFEFYELAKLLPLPAAITSQLDKASIIRLTISYLKMRDFANQGDPPWNLRMEGPPPNTSVKDGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 828171 - protein, 667 aa, Homo sapiens
MKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 828172 - protein, 273 aa, Homo sapiens
AAAGVPAGAGMGRAGAAANGTPQNVQGITSYQQRITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKVCAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVVCFPPASDQFLL

SEQ ID NO: 828173 - protein, 231 aa, Homo sapiens
AAAGVPAGAGMGRAGAAANGTPQNVQGITSYQQRITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKVCAQRRRSPSALAIEVFEAHLGSHILQSLDGFVFALNQEGKFLYISETVSIYLGLSQAQTLCSPLQSHRRPSRCSVAKLQSIYVTF

SEQ ID NO: 828174 - protein, 401 aa, Homo sapiens
AAAGVPAGAGMGRAGAAANGTPQNVQGITSYQQRITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKVCAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDS

SEQ ID NO: 828175 - protein, 214 aa, Homo sapiens
AAAGVPAGAGMGRAGAAANGTPQNVQGITSYQQRITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKVCAQRRRSPSALAIEVFEAHLGSHILQSLDGFVFALNQEGKFLYISETVSIYLGLSQVSKTILDSWQRL

SEQ ID NO: 828176 - protein, 94 aa, Homo sapiens
RGRSSPAEARGGWGGTMADVFPGNDSTASQDVANRFARKGALRQKNVHEVKDHKFIARFFKQPTFCSHCTDFIWGFGKQGFQCQVAEQTVAACL

SEQ ID NO: 828177 - protein, 97 aa, Homo sapiens
RGRSSPAEARGGWGGTMADVFPGNDSTASQDVANRFARKGALRQKNVHEVKDHKFIARFFKQPTFCSHCTDFIWGFGKQGFQCQGKLPLLVLFSSTT

SEQ ID NO: 828178 - protein, 688 aa, Homo sapiens
RGRSSPAEARGGWGGTMADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSICKGLMTKHPAKRLGCGPEGERDVREHAFFRRIDWEKLENREIQPPFKPKVCGKGAENFDKFFTRGQPVLTPPDQLVIANIDQSDFEGFSYVNPQFVHPILQSAV

SEQ ID NO: 828179 - protein, 654 aa, Homo sapiens
RGRSSPAEARGGWGGTMADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSICKGLMTKHPAKRLGCGPEGERDVREHAFFRRIDWEKLENREIQPPFKPKVPCEMGTMVPSLQWRKQSQRG

SEQ ID NO: 828180 - protein, 624 aa, Homo sapiens
MPPTAPTSSGGLGRQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSICKGLMTKHPAKRLGCGPEGERDVREHAFFRRIDWEKLENREIQPPFKPKVCGKGAENFDKFFTRGQPVLTPPDQLVIANIDQSDFEGFSYVNPQFVHPILQSAV

SEQ ID NO: 828181 - protein, 319 aa, Homo sapiens
MLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSICKGLMTKHPAKRLGCGPEGERDVREHAFFRRIDWEKLENREIQPPFKPKVCGKGAENFDKFFTRGQPVLTPPDQLVIANIDQSDFEGFSYVNPQFVHPILQSAV

SEQ ID NO: 828182 - protein, 341 aa, Homo sapiens
RGRSSPAEARGGWGGTMADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNIGNFQGRKISEGGGDLTKKWPPGKPTL

SEQ ID NO: 828183 - protein, 296 aa, Homo sapiens
RGRSSPAEARGGWGGTMADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYGSRLG

SEQ ID NO: 828184 - protein, 160 aa, Homo sapiens
ITLMFSFPAASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 828185 - protein, 509 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 828186 - protein, 509 aa, Homo sapiens; identical to SEQ ID NO: 828185

SEQ ID NO: 828187 - protein, 501 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPRCHMTGRVLWETLISLRWCGPEQSWYLG

SEQ ID NO: 828188 - protein, 555 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAAGKCDGENSSHFLVCVSFLMASALCRILPELPKLQATYMKPVWFQRLREVPPSFRRKSIALSEFSLSSALLIQVNLKVPASQVTLTLRTSQKIVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPRCHMTGRVLWETLISLRWCGPEQSWYLG

SEQ ID NO: 828189 - protein, 512 aa, Homo sapiens
GHLIQDNSPRSPAGFSCHHEDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPRCHMTGRVLWETLISLRWCGPEQSWYLG

SEQ ID NO: 828190 - protein, 439 aa, Homo sapiens
MVILFKGIPLESTDGERLVKSPQCSNPGLCVQPHHIGVSVKELDLYLAYFVHAAGKCDGENSSHFLVCVSFLMASALCRILPELPKLQATYMKPVWFQKIERGATFIQVKKHSFERILTKFSSFDSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPRCHMTGRVLWETLISLRWCGPEQSWYLG

SEQ ID NO: 828191 - protein, 501 aa, Homo sapiens; identical to SEQ ID NO: 828187

SEQ ID NO: 828192 - protein, 216 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENDGKFSLGL

SEQ ID NO: 828193 - protein, 191 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAAGGVGR

SEQ ID NO: 828194 - protein, 748 aa, Homo sapiens
MSQWNQVQQLEIKFLEQVDQFYDDNFPMEIRHLLAQWIENQDWEAASNNETMATILLQNLLIQLDEQLGRVSKEKNLLLIHNLKRIRKVLQGKFHGNPMHVAVVISNCLREERRILAAANMPVQGPLEKSLQSSSVSERQRNVEHKVAAIKNSVQMTEQDTKYLEDLQDEFDYRYKTIQTMDQSDKNSAMVNQEVLTLQEMLNSLDFKRKEALSKMTQIIHETDLLMNTMLIEELQDWKRRQQIACIGGPLHNGLDQLQNCFTLLAESLFQLRRQLEKLEEQSTKMTYEGDPIPMQRTHMLERVTFLIYNLFKNSFVVERQPCMPTHPQRPLVLKTLIQFTVKLRLLIKLPELNYQVKVKASIDKNVSTLSNRRFVLCGTNVKAMSIEESSNGSLSVEFRHLQPKEMKSSAGGKGNEGCHMVTEELHSITFETQICLYGLTIDLETSSLPVVMISNVSQLPNAWASIIWYNVSTNDSQNLVFFNNPPPATLSQLLEVMSWQFSSYVGRGLNSDQLHMLAEKLTVQSSYSDGHLTWAKFCKEHLPGKSFTFWTWLEAILDLIKKHILPLWIDGYVMGFVSKEKERLLLKDKMPGTFLLRFSESHLGGITFTWVDHSESGEVRFHSVEPYNKGRLSALPFADILRDYKVIMAENIPENPLKYLYPDIPKDKAFGKHYSSQPCEVSRPTERGDKGYVPSVFIPISTIRSDSTEPHSPSDLLPMSPSVYAVLRENLSPTTIETAMKSPYSAE

SEQ ID NO: 828195 - protein, 748 aa, Homo sapiens; identical to SEQ ID NO: 828194

SEQ ID NO: 828196 - protein, 498 aa, Homo sapiens
MSQWNQVQQLEIKFLEQVDQFYDDNFPMEIRHLLAQWIENQDWEAASNNETMATILLQNLLIQLDEQLGRVSKEKNLLLIHNLKRIRKVLQGKFHGNPMHVAVVISNCLREERRILCFTLSNRRFVLCGTNVKAMSIEESSNGSLSVEFRHLQPKEMKSSAGGKGNEGCHMVTEELHSITFETQICLYGLTIDLETSSLPVVMISNVSQLPNAWASIIWYNVSTNDSQNLVFFNNPPPATLSQLLEVMSWQFSSYVGRGLNSDQLHMLAEKLTVQSSYSDGHLTWAKFCKEHLPGKSFTFWTWLEAILDLIKKHILPLWIDGYVMGFVSKEKERLLLKDKMPGTFLLRFSESHLGGITFTWVDHSESGEVRFHSVEPYNKGRLSALPFADILRDYKVIMAENIPENPLKYLYPDIPKDKAFGKHYSSQPCEVSRPTERGDKGYVPSVFIPISTIRSDSTEPHSPSDLLPMSPSVYAVLRENLSPTTIETAMKSPYSAE

SEQ ID NO: 828197 - protein, 721 aa, Homo sapiens
MEIRHLLAQWIENQDWEAASNNETMATILLQNLLIQLDEQLGRVSKEKNLLLIHNLKRIRKVLQGKFHGNPMHVAVVISNCLREERRILAAANMPVQGPLEKSLQSSSVSERQRNVEHKVAAIKNSVQMTEQDTKYLEDLQDEFDYRYKTIQTMDQSDKNSAMVNQEVLTLQEMLNSLDFKRKEALSKMTQIIHETDLLMNTMLIEELQDWKRRQQIACIGGPLHNGLDQLQNCFTLLAESLFQLRRQLEKLEEQSTKMTYEGDPIPMQRTHMLERVTFLIYNLFKNSFVVERQPCMPTHPQRPLVLKTLIQFTVKLRLLIKLPELNYQVKVKASIDKNVSTLSNRRFVLCGTNVKAMSIEESSNGSLSVEFRHLQPKEMKSSAGGKGNEGCHMVTEELHSITFETQICLYGLTIDLETSSLPVVMISNVSQLPNAWASIIWYNVSTNDSQNLVFFNNPPPATLSQLLEVMSWQFSSYVGRGLNSDQLHMLAEKLTVQSSYSDGHLTWAKFCKEHLPGKSFTFWTWLEAILDLIKKHILPLWIDGYVMGFVSKEKERLLLKDKMPGTFLLRFSESHLGGITFTWVDHSESGEVRFHSVEPYNKGRLSALPFADILRDYKVIMAENIPENPLKYLYPDIPKDKAFGKHYSSQPCEVSRPTERGDKGYVPSVFIPISTIRSDSTEPHSPSDLLPMSPSVYAVLRENLSPTTIETAMKSPYSAE

SEQ ID NO: 828198 - protein, 328 aa, Homo sapiens [sequence omitted]

SEQ ID NO: 828199 - protein, 704 aa, Homo sapiens
MSQWNQVQQLEIKFLEQVDQFYDDNFPMEIRHLLAQWIENQDWEAASNNETMATILLQNLLIQLDEQLGRVSKEKNLLLIHNLKRIRKVLQGKFHGNPMHVAVVISNCLREERRILAAANMPVQGPLEKSLQSSSVSERQRNVEHKVAAIKNSVQMTEQDTKYLEDLQDEFDYRYKTIQTMDQSDKNSAMVNQEVLTLQEMLNSLDFKRKEALSKMTQIIHETDLLMNTMLIEELQDWKRRQQIACIGGPLHNGLDQLQNCFTLLAESLFQLRRQLEKLEEQSTKMTYEGDPIPMQRTHMLERVTFLIYNLFKNSFVVERQPCMPTHPQRPLVLKTLIQFTVKLRLLIKLPELNYQVKVKASIDKNVSTLSNRRFVLCGTNVKAMSIEESSNGSLSVEFRHLQPKEMKSSAGGKGNEGCHMVTEELHSITFETQICLYGLTIDLETSSLPVVMISNVSQLPNAWASIIWYNVSTNDSQNLVFFNNPPPATLSQLLEVMSWQFSSYVGRGLNSDQLHMLAEKLTVQSSYSDGHLTWAKFCKEHLPGKSFTFWTWLEAILDLIKKHILPLWIDGYVMGFVSKEKERLLLKDKMPGTFLLRFSESHLGGITFTWVDHSESGEVRFHSVEPYNKGRLSALPFADILRDYKVIMAENIPENPLKYLYPDIPKDKAFGKHYSSQPCEVSRPTERGDKGYVPSVFIPISTM

SEQ ID NO: 828200 - protein, 136 aa, Homo sapiens
MSQWNQVQQLEIKFLEQVDQFYDDNFPMEIRHLLAQWIENQDWEAASNNETMATILLQNLLIQLDEQLGRVSKEKNLLLIHNLKRIRKVLQGKFHGNPMHVAVVISNCLREERRILAAANMPVQVIFSDLVILLSP

SEQ ID NO: 828201 - protein, 161 aa, Homo sapiens
SGGFLTVRRPNPPLRRGGTLQAARHTERTPVDDQRRGRRSLEGKVKETVHNAFGDHLKEQLSATPPDFSCALELLKEIKEILLSLLLPRQNRLRIEMEEALDMDLLKQEAEHGALKVLYLSKYVLNMMALLCAPVRDEAVQKLENITDPVWILRMTIVKEI

SEQ ID NO: 828202 - protein, 223 aa, Homo sapiens
LVVRGTQGSYIGQDCREIPEHLGRDCGHFAKRLDLSFNLLRSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 828203 - protein, 218 aa, Homo sapiens
LICPMDGCSFLPVGLRCLRAAQRDFFGLGILTLFLKSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 828204 - protein, 211 aa, Homo sapiens
TLLARVSCHAISSRNRKLNWELVGSQEEKSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 828205 - protein, 244 aa, Homo sapiens
MCFSFILFPLPPKPWSTCCCSHASCQQWHLLSVAIKNLNVNIFALKEWKSICHSAAIILQIKSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 828206 - protein, 85 aa, Homo sapiens
QTWKCWHVDRPCTKNPAEDSESLRCFLLIFFAKHLLSLILEVRGGKRQVSWGSVATFTMGKTQRATGLSEMTSSEANFCIPSPIS

SEQ ID NO: 828207 - protein, 307 aa, Homo sapiens
LICPMDGCSFLPVGLRCLRAAQRDFFGLGILTLLLKNRRDFSGCRLRCIYPNTSTLAGDPARNGSRLVVYAVHARPTQDSRWFLCARVAAKSALRGRSGHAAPPGQSGSRCLAVPGRPHLCQLLRNTRLVHGFARGEKMTSKFPNRGSRNFLDEGSLLRLCLENPHELLQLAREIRWRSGRRTKGGAGEQGGHWVTQPGPGETLEKGALLSLFQCNSSARDGITEFPGCADAPMCLRDPTGRRRSLKLRKLAEVRRGVQNWGVLSWAVPIAGDPPFVSLAGLLRADRRQGRVNRAPPGGGGPAHPGC

SEQ ID NO: 828208 - protein, 153 aa, Homo sapiens
ARYEAGWLLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 828209 - protein, 226 aa, Homo sapiens
MCFSFILFPLPPKPWSTCCCSHASCQQWHLLSVAIKNLNVNIFALKEWKSICHSAAIILQIKSLEGLSAFRSLEELILDNNQLGDDLVLPGLPRLHTLTLNKNRITDLENLLDHLAEVTPALEYLSLLGNVACPNELVSLANLKFLDAQKVTRQEREEALVRGVFMKVVKPKASSEDVASSPERHYTPLPSASRELTSHQGVLGKCRYVYYGKNSEGNRFIRDDQL

SEQ ID NO: 828210 - protein, 219 aa, Homo sapiens
LLLLNSPPSIKNLNVNIFALKEWKSICHSAAIILQIKSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 828211 - protein, 219 aa, Homo sapiens; identical to SEQ ID NO: 828210

SEQ ID NO: 828212 - protein, 219 aa, Homo sapiens; identical to SEQ ID NO: 828210

SEQ ID NO: 828213 - protein, 216 aa, Homo sapiens
LVVRGTQVSYIGQDCREIPEHLGRDCGHFAKRLDLSFNLLRSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQDLNIPVLRIHSKLAVLCHC

SEQ ID NO: 828214 - protein, 250 aa, Homo sapiens
LVVRGTQVSYIGQDCREIPEHLGRDCGHFAKRLDLSFNLLRSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQDEVSFLSPRLECSGAFSAHCNLRLPGSSDSPVSASQVAGNTGMCHHAQLILYF

SEQ ID NO: 828215 - protein, 264 aa, Homo sapiens
LVVRGTQGSYIGQDCREIPEHLGRDCGHFAKRLDLSFNLLRSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQDEVSFLSPRLECSGAFSAHCNLRLPGSSDSPVSASQVAGNTGVLGKCRYVYYGKNSEGNRFIRDDQL

SEQ ID NO: 828216 - protein, 368 aa, Homo sapiens
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNHNGNIFAYASSYDWSKGHEFYNPQKKNYIFLRNAAEELKPRNKK

SEQ ID NO: 828217 - protein, 250 aa, Homo sapiens
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNP

SEQ ID NO: 828218 - protein, 434 aa, Homo sapiens
MCCRLAGKGAFFFDDFRATQEVAPGRTRVVSAVVRAVSTAGLRRLRAPGISVRAPGPRPSRQSRFKMSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNHNGNIFAYASSYDWSKGHEFYNPQKKNYIFLRNAAEELKPRNKK

SEQ ID NO: 828219 - protein, 368 aa, Homo sapiens; identical to SEQ ID NO: 828216

SEQ ID NO: 828220 - protein, 285 aa, Homo sapiens [sequence omitted]

SEQ ID NO: 828221 - protein, 291 aa, Homo sapiens
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAGHGFQPLEKTMSLFSS

SEQ ID NO: 828222 - protein, 175 aa, Homo sapiens
LSAKYEAGCYSAEGISTEYHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNHNGNIFAYASSYDWSKGHEFYNPQKKNYIFLRNAAEELKPRNKK

SEQ ID NO: 828223 - protein, 119 aa, Homo sapiens
MCCRLAGKGAFFFDDFRATQEVAPGRTRVVSAVVRAVSTAGLRRLRAPGISVRAPGPRPSRQSRFANSSDPSAPGRRFPPGRDPQVQNEPVWNNLRFWNQWDQHVWQCNYRQSQSHEGY

SEQ ID NO: 828224 - protein, 368 aa, Homo sapiens; identical to SEQ ID NO: 828216

SEQ ID NO: 828225 - protein, 368 aa, Homo sapiens; identical to SEQ ID NO: 828216

SEQ ID NO: 828226 - protein, 383 aa, Homo sapiens
LLTKLRYWALEARFKMSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNHNGNIFAYASSYDWSKGHEFYNPQKKNYIFLRNAAEELKPRNKK

SEQ ID NO: 828227 - protein, 363 aa, Homo sapiens
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNQDMDFNPWRKRCHCSAAESPGVRGDLPSLHSTACCRVFL

SEQ ID NO: 828228 - protein, 344 aa, Homo sapiens
MCCRLAGKGAFFFDDFRATQEVAPGRTRVVSAVVRAVSTAGLRRLRAPGISVRAPGPRPSRQSRFKMSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVRF

SEQ ID NO: 828229 - protein, 537 aa, Homo sapiens
AGAVWSAAEGACGPRQPNKGAGAPPQGPATHLPGPRSGLSSTATMTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 828230 - protein, 537 aa, Homo sapiens; identical to SEQ ID NO: 828229

SEQ ID NO: 828231 - protein, 111 aa, Homo sapiens
MSGPGVPDTHARPSEVAQPRTPWPPGLSAGSEGPPWTGPEPNAEDSTGKYWTVGSDSAVTSSGDTPVDFFFEFCDYNKVAIKVGGRYLKGDHAGVLKASAETVDPASLWEY

SEQ ID NO: 828232 - protein, 263 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGVLGVGPGPPGGGPGEALLVAVPFVGAGLPRCVTRR

SEQ ID NO: 828233 - protein, 493 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 828234 - protein, 537 aa, Homo sapiens; identical to SEQ ID NO: 828229

SEQ ID NO: 828235 - protein, 537 aa, Homo sapiens; identical to SEQ ID NO: 828229

SEQ ID NO: 828236 - protein, 531 aa, Homo sapiens
AWGGALSNALRPGVTGAAAATATRGAGTTRSGLSSTATMTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 828237 - protein, 537 aa, Homo sapiens; identical to SEQ ID NO: 828229

SEQ ID NO: 828238 - protein, 537 aa, Homo sapiens; identical to SEQ ID NO: 828229

SEQ ID NO: 828239 - protein, 537 aa, Homo sapiens; identical to SEQ ID NO: 828229

SEQ ID NO: 828240 - protein, 537 aa, Homo sapiens; identical to SEQ ID NO: 828229

SEQ ID NO: 828241 - protein, 473 aa, Homo sapiens
AGAVWSAAEGACGPRQPNKGAGAPPQGPATHLPGPRSGLSSTATMTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFLLSLSFHPSLTGSRK

SEQ ID NO: 828242 - protein, 537 aa, Homo sapiens; identical to SEQ ID NO: 828229

SEQ ID NO: 828243 - protein, 537 aa, Homo sapiens; identical to SEQ ID NO: 828229

SEQ ID NO: 828244 - protein, 537 aa, Homo sapiens; identical to SEQ ID NO: 828229

SEQ ID NO: 828245 - protein, 537 aa, Homo sapiens; identical to SEQ ID NO: 828229

SEQ ID NO: 828246 - protein, 419 aa, Homo sapiens
SVPTKARYEAGWLIGRGLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 828247 - protein, 556 aa, Homo sapiens
AGAVWSAAEGACGPRQPNKGAGAPPQGPATHLPGPRSGLSSTATMTANGTAEAVQIQFGLINCGNKYLTAEAFGFKVNASASSLKKKQIWTLEQPPDEAGSAAVCLRSHLGRYLAADKDGNVTCELLSVALVPDLPSFAPILVVPATGPGTVVCIVVLRCDGPDVLTPVLASFCAVHLMDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 828248 - protein, 478 aa, Homo sapiens
AGAVWSAAEGACGPRQPNKGAGAPPQGPATHLPGPRSGLSSTATMTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKAPPPGALG

SEQ ID NO: 828249 - protein, 457 aa, Homo sapiens
AGAVWSAAEGACGPRQPNKGAGAPPQGPATHLPGPRSGLSSTATMTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGGLKKLLPLQVERLPFKTRAPNSIRCYQPGEASGSIGAARKGS

SEQ ID NO: 828250 - protein, 381 aa, Homo sapiens
AGAVWSAAEGACGPRQPNKGAGAPPQGPATHLPGPRSGLSSTATMTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATARGGNHAQKAPHCIWGR

SEQ ID NO: 828251 - protein, 98 aa, Homo sapiens
SVPTKARYEAGWLIGRGVFQLEFNDGAYNIKDSTGKYWTVGSDSAVTSSGDTPVDFFFEFCDYNKVAIKVGGRYLKGDHAGVLKASAETVDPASLWEY

SEQ ID NO: 828252 - protein, 162 aa, Homo sapiens
WLELLTSSDPPTSASQSAGITGVSHCGRAEHVLGPLFMCPSWTGGRAGHRDPGSFRSRDWRVGRHPWEHPCPPSAAQGRGGEPGFGPPLDKVPSPDSTGKYWTVGSDSAVTSSGDTPVDFFFEFCDYNKVAIKVGGRYLKGDHAGVLKASAETVDPASLWEY

SEQ ID NO: 828253 - protein, 432 aa, Homo sapiens
MAAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHTLPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 828254 - protein, 409 aa, Homo sapiens [sequence omitted]

SEQ ID NO: 828255 - protein, 441 aa, Homo sapiens
TSARYEAGFDIGRGEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHTLPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 828256 - protein, 441 aa, Homo sapiens
KQAVRRIRSSHASLEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHTLPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 828257 - protein, 355 aa, Homo sapiens [sequence omitted]

SEQ ID NO: 828258 - protein, 594 aa, Homo sapiens
MAAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHTLPITDLHCGFGGPLARVATSSLDQTVKVRRPHPTTVHERSPAAAGPQPGMQESPPPAPCCQDSRRLLIPWCSEPKDVQGGLPAWKFLLIHRFWPGSLAKPGESEVITMLECDRWSWEGEPGVISRRPSSISAQAMSPGPQDPHGDGFHPKSQALGPEDSRRLTSLVPLFPWGPRVPPAGPSPTPFAHPQLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 828259 - protein, 403 aa, Homo sapiens
KQAVRRIRSSHASLEVAVCTDSAAPMWSCIVWELHSGANLLTYRGGQAGEPPAGPWAACSNGEVLCAGRLSWLRDSENVPADCCVHGLYVCDASITVESRNLSSVYRVLPSVHRGQRTSSQGARTAGALEPLQRAAADPSDSGQAVGSPAPPDLPGLGAPAGGTPPEQRELWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 828260 - protein, 436 aa, Homo sapiens
MTHVRGGGGRQDGGAHGGGRVYGLGGPDVELHRVGTSLGRQPAHLPRRPGGTPRPGAAQWRVSAGGAAGQELHQRLGAPAEGPAPAEDHVPRACHLSDCITQWSLRPGRSCRKHPPVGGLHREPSGHPESTLPGRLLPSVHRGQQPLHLRGQGLPGAGLEPLQRAAGRPLQDSGAQARLVSPHAPHHGPALRLWGPPGPGGHLLTGPDGEVRAPSSRSTSSPGLSAAVCGLHPALGLRARACGSHTSRPSQPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 828261 - protein, 79 aa, Homo sapiens
ILCSFIFFPHHLLCSVGPRGFFQSPRTLHAFFIYEVSVLGGQDQLRVRVTELEDEVRNLRKINRDLFDFSTRFITRPAK

SEQ ID NO: 828262 - protein, 152 aa, Homo sapiens
MAAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCR

SEQ ID NO: 828263 - protein, 179 aa, Homo sapiens [sequence omitted]

SEQ ID NO: 828264 - protein, 298 aa, Homo sapiens
THIWLMCLMAWVVLPTTKLGSEESCKLRRLRFTYGTQTRVSLALPGQYELVHTLVAHQGNWETIPEEDLEVQENNEDAAHVLAELEVTMHHALLQEVDVVVAPCQGLRPTVDVLGDLVNDFLPVITYALHKDELSERDEQELQEIRKYFSFPVFFFKVPKLGSEIIDSSTRRMESERSPLYRQLIDLGYLSSSHWNCGAPGQDTKAQSMLVEQSEKLRHLSTFSHQVLQTRLVDAAKALNLVHCHCLDIFINQAFDMQRDLQITPKRLEYTRKKENELYESYDEYCRKQEEMKDMIVE

SEQ ID NO: 828265 - protein, 79 aa, Homo sapiens
LVRSPCRNSARAFSYGGGMNRACLMLKWVRREWPETLVFQTLLEVSSSTTVPKRVSFLTSSVLLTSSPIEVISEVHQDI

SEQ ID NO: 828266 - protein, 196 aa, Homo sapiens
PWGSEPVSGPGPGGGGMIRELCRGFGRYRRYLGRLRQNLRETQKFFRDIKCSHNHTCLSSLTGGGGAERGPAGDVAETGLQAGQLSCISFPPKEEKYLQQIVDCLPCILILGQDCNVKCQLLNLLLGVQVLPTTKLGSEESCKLRRLRFTYGTQTRVSLALPGQYELVHTLVAHQGNWETIPEAGESLEPGRQRSW

SEQ ID NO: 828267 - protein, 443 aa, Homo sapiens
LRESFVGTLERCLQSLEKSQDVSVHITSNYLKQILNAAYHVEVTFHSGSSVTRMLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESRSLQDVLLHRKPKLGQELGRGQYGVVYLCDNWGGHFPCALKSVVPPDEKHWNDLALEFHYMRSLPKHERLVDLHGSVIDYNYGGGSSIAVLLIMERLHRDLYTGLKAGLTLETRLQIALDVVEGIRFLHSQGLVHRDIKLKNVLLDKQNRAKITDLGFCKPEAMMSGSIVGTPIHMAPELFTGKYDNSVDVYAFGILFWYICSGSVKLPEAFERCASKDHLWNNVRRGARPERLPVFDEECWQLMEACWDGDPLKRPLLGIVQPMLQGIMNRLCKSNSEQPNRGLDDST

SEQ ID NO: 828268 - protein, 181 aa, Homo sapiens
PQSDRLTGIALDVVEGIRFLHSQGLVHRDIKLKNVLLDKQNRAKITDLGFCKPEAMMSGSIVGTPIHMAPELFTGKYDNSVDVYAFGILFWYICSGSVKLPEAFERCASKDHLWNNVRRGARPERLPVFDEECWQLMEACWDGDPLKRPLLGIVQPMLQGIMNRLCKSNSEQPNRGLDDST

SEQ ID NO: 828269 - protein, 398 aa, Homo sapiens
LRESFVGTLERCLQSLEKSQDVSVHITSNYLKQILNAAYHVEVTFHSGSSVTRMLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESRSLQDVLLHRKPKLGQELGRGQYGVVYLCDNWGGHFPCALKSVVPPDEKHWNDLALEFHYMRSLPKHERLVDLHGSVIDYNYGGGSSIAVLLIMERLHRDLYTGLKAGLTLETRLQIALDVVEGIRFLHSQGLVHRDIKLKNVLLDKQNRAKITDLGFCKPEAMMSGSIVGTPIHMAPELFTGARPERLPVFDEECWQLMEACWDGDPLKRPLLGIVQPMLQGIMNRLCKSNSEQPNRGLDDST

SEQ ID NO: 828270 - protein, 74 aa, Homo sapiens
FDGVLPPQVQVSQTDLYLNGETLCLPVASAPVREDLPHCTGIICDLQEQEVEGSSCLCLHPEHRRASTVFWLHK

SEQ ID NO: 828271 - protein, 415 aa, Homo sapiens
PWGSEPVSGPGPGGGGMIRELCRGFGRYRRYLGRLRQNLRETQKFFRDIKCSHNHTCLSSLTGGGGAERGPAGDVAETGLQAGQLSCISFPPKEEKYLQQIVDCLPCILILGQDCNVKCQLLNLLLGVQVLPTTKLGSEESCKLRRLRFTYGTQTRVSLALPGQYELVHTLVAHQGNWETIPEEDLEVQENNEDAAHVLAELEVTMHHALLQEVDVVVAPCQGLRPTVDVLGDLVNDFLPVITYALHKDELSERDEQELQEIRKYFSFPVFFFKVPKLGSEIIDSSTRRMESERSPLYRQLIDLGYLSSSHWNCGAPGQDTKAQSMLVEQSEKLRHLSTFSHQVLQTRLVDAAKALNLVHCHCLDIFINQAFDMQRDLQITPKRLEYTRKKENELYESYDEYCRKQEEMKDMIVE

SEQ ID NO: 828272 - protein, 398 aa, Homo sapiens; identical to SEQ ID NO: 828269

SEQ ID NO: 828273 - protein, 276 aa, Homo sapiens
LRESFVGTLERCLQSLEKSQDVSVHITSNYLKQILNAAYHVEVTFHSGSSVTRMLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESRSLQDVLLHRKPKLGQELGRGQYGVVYLCDNWGGHFPCALKSVVPPDEKHWNDLALEFHYMRSLPKHERLVDLHGSVIDYNYGGGSSIAVLLIMERLHRDLYTGLKAGLTLEVDAAANLVVV

SEQ ID NO: 828274 - protein, 573 aa, Homo sapiens
AAAAAAARRRRPRPRGASRPHPGGVAAAVAASAARAPEFRSLPPAGVRGPAGPARAGHAFGAAQPGRPGAAPRARAPRGPRPRPPLSPGGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 828275 - protein, 589 aa, Homo sapiens
AAAAAAARRRRPRPRGASRPHPGGVAAAVAASAARAPEFRSLPPAGVRGPAGPARAGHAFGAAQPGRPGAAPRARAPRGPRPRPPLSPGGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGFTTAAYLRIHAVKDHGLQAPRADRILCKLCSVHCKTPAQLAGHMQTHLGGAGPPVPGDAPQPQPTC

SEQ ID NO: 828276 - protein, 581 aa, Homo sapiens
IPGVPALRGPKRPPFLPPPAGVAGAGRRGPCDLGAAQPGRRRPAPAGAWGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTCRGLPGGGGSGSSGSSSSPSHSCGLPLGGGGGACELSATSLPTLVSSKLVAGERGEWSRVPWYKLLSPLFSHQLLFPYQPRSLQKERRKKCFLRGIR

SEQ ID NO: 828277 - protein, 510 aa, Homo sapiens
AAAAAAARRRRPRPRGASRPHPGGVAAAVAASAARAPEFRSLPPAGVRGPAGPARAGHAFGAAQPGRPGAAPRARAPRGPRPRPPLSPGGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRCARGLGRPLGRGEGGTRRRWPGRGWRGGRRLLRLGKGSHSQGGGRKPLPVTREQGVVLCRGGGPWG

SEQ ID NO: 828278 - protein, 510 aa, Homo sapiens; identical to SEQ ID NO: 828277

SEQ ID NO: 828279 - protein, 181 aa, Homo sapiens
AAAAAAARRRRPRPRGASRPHPGGVAAAVAASAARAPDFRLPPAGRGARAGGAGPGRANAFGAAQPGRPGAAPRARAPRGPRPRPPLSPGGPAAAEAMFPVFPCTLLAPPFPVLGLDSRGVGGLMNSFPPPQGHAQNPLQVGAELQSRFFASQGCAQSPFQAGSPQQSRQTSALNRTALQM

SEQ ID NO: 828280 - protein, 552 aa, Homo sapiens
PPPPPPPPGATAPGPGPAGPPAPTQGASPPPSPRPRPARRPNSGSLPPAGVRGPAGPARAGHAFGAAQPGRPGAAPRARAPRGPRPRPPLSPGGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTCRGLPGGPGAEGGRLARRLATDTG

SEQ ID NO: 828281 - protein, 573 aa, Homo sapiens; identical to SEQ ID NO: 828274

SEQ ID NO: 828282 - protein, 573 aa, Homo sapiens; identical to SEQ ID NO: 828274

SEQ ID NO: 828283 - protein, 573 aa, Homo sapiens; identical to SEQ ID NO: 828274

SEQ ID NO: 828284 - protein, 573 aa, Homo sapiens; identical to SEQ ID NO: 828274

SEQ ID NO: 828285 - protein, 231 aa, Homo sapiens
AAAAAAARRRRPRPRGASRPHPGGVAAAVAASAARAPEFRLPPAGRGARAGGAGPGRANAFGAAQPGRPGAAPRARAPRGPRPRPPLSPGGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAVAAPPTAVGSLSGAEGVPVSSQPLPSQPW

SEQ ID NO: 828286 - protein, 224 aa, Homo sapiens
AAAAAAARRRRPRPRGASRPHPGGVAAAVAASAARAPDFRLPPAGRGARAGGAGPGRANAFGAAQPGRPGAAPRARAPRGPRPRPPLSPGGPAAAEAMFPVFPCTLLAPPFPVLGLDSRGVGGLMNSFPPPQGHAQNPLQVGAELQSRFCGLPLGGGGGACELSATSLPTLVSSKLVAGERGEWSRVPWYKLLSPLFSHQLLFPYQPRSLQKERRKKCFLRGIR

SEQ ID NO: 828287 - protein, 589 aa, Homo sapiens; identical to SEQ ID NO: 828275

SEQ ID NO: 828288 - protein, 111 aa, Homo sapiens
GRVGCARGLWAHTVRHEEKVPCHVCGKMLSSAYISDHMKVHSQGPHHVCELCNKGFTTAAYLRIHAVKDHGLQAPRADRILCKLCSVHCKTPAQLAGPQPRRGILLEIDQQ

SEQ ID NO: 828289 - protein, 510 aa, Homo sapiens; identical to SEQ ID NO: 828277

SEQ ID NO: 828290 - protein, 592 aa, Homo sapiens
AAAAAAARRRRPRPRGASRPHPGGVAAAVAASAARAPEFRSLPPAGVRGPAGPARAGHAFGAAQPGRPGAAPRARAPRGPRPRPPLSPGGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRCARGLGRPLGRGEGGTRRRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 828291 - protein, 619 aa, Homo sapiens
AAAAAAARRRRPRPRGASRPHPGGVAAAVAASAARAPEFRSLPPAGVRGPAGPARAGHAFGAAQPGRPGAAPRARAPRGPRPRPPLSPGGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEASSCHSHFLQIKDPQGSDSFNLLLPPPQPTNFNSPVTPPTPLPPPQKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 828292 - protein, 552 aa, Homo sapiens; identical to SEQ ID NO: 828280

SEQ ID NO: 828293 - protein, 573 aa, Homo sapiens; identical to SEQ ID NO: 828274

SEQ ID NO: 828294 - protein, 510 aa, Homo sapiens; identical to SEQ ID NO: 828277

SEQ ID NO: 828295 - protein, 573 aa, Homo sapiens; identical to SEQ ID NO: 828274

SEQ ID NO: 828296 - protein, 573 aa, Homo sapiens; identical to SEQ ID NO: 828274

SEQ ID NO: 828297 - protein, 579 aa, Homo sapiens
AAAAAAARRRRPRPRGASRPHPGGVAAAVAASAARAPEFRSLPPAGVRGPAGPARAGHAFGAAQPGRPGAAPRARAPRGPRPRPPLSPGGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPPEGKEEEMFS

SEQ ID NO: 828298 - protein, 573 aa, Homo sapiens; identical to SEQ ID NO: 828274

SEQ ID NO: 828299 - protein, 429 aa, Homo sapiens
GKKKRRKNFEAMFKGILQSGLDNFVINHMLKNNVAGQTSIQTLVPNTDQKSTSVKKDNHKKKTVKMLEYLGKDVLHGVFNYLAKHDVLTLKEEEKKKYYDAKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLAVISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 828300 - protein, 99 aa, Homo sapiens
FQCCTKRQRLLAMAEDNHKKKTVKMLEYLGKDVLHGVFNYLAKHDVLTLKEEEKKKYYDAKIEDKALILVDSLRKNRVAHQMFTQTLLNMDQKITSVKQ

SEQ ID NO: 828301 - protein, 388 aa, Homo sapiens
FQCCTKRQRLLAMAEDNHKKKTVKMLEYLGKDVLHGVFNYLAKHDVLTLKEEEKKKYYDAKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLAVISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 828302 - protein, 235 aa, Homo sapiens
VGAPGRWRRRRRGSSVTGARPVKTLLAGATSLPAARNGNGVKGDPSTWPRGSAMELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASLESLEKPEAYVSEY

SEQ ID NO: 828303 - protein, 120 aa, Homo sapiens
RLRLKTKQNKANEVNYFGKHIFWFPKGVLTNTHLRHRLKSVLKVYDGRRARLCPGTMSGSVPWCSLGVLMVVFPVSCTDQLDIISMAETTMMPEEIELEMAKIQRLREVLVRRESELRFM

SEQ ID NO: 828304 - protein, 257 aa, Homo sapiens
VGAPGRWRRRRRGSSVTGARPVKTLLAGATSLPAARNGNGVKGDPSTWPRGSAMELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASSRAEKKAEPPPSKPTVAKTGLALIKDCCGATQCNIM

SEQ ID NO: 828305 - protein, 204 aa, Homo sapiens
VGAPGRWRRRRRGSSVTGARPVKTLLAGATSLPAARNGNGVKGDPSTWPRGSAMELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLRLPGREESRAPT

SEQ ID NO: 828306 - protein, 187 aa, Homo sapiens
MWGDLTETGCMGRRSAKKDQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASSRAEKKAEPPPSKPTVAKTGLALIKDCCGATQCNIM

SEQ ID NO: 828307 - protein, 127 aa, Homo sapiens
MDDIQLCKDIMDLKQELQNLVAIPEKEKTKLQKQREDELIQKIHKLVQKRDFLVDDAEVERLREQEEDKEMADFLRIKLKPLDKVTKSPASSRAEKKAEPPPSKPTVAKTGLALIKDCCGATQCNIM

SEQ ID NO: 828308 - protein, 141 aa, Homo sapiens
VGAPGRWRRRRRGSSVTGARPVKTLLAGATSLPAARNGNGVKGDPSTWPRGSAMELKQSLSTHLEAEKPLRRYGAVEETAWKTERLGRNQLDIISMAETTMMPEEIELEMAKIQRLREVLVRRESELRFMLCNLAQISYLL

SEQ ID NO: 828309 - protein, 253 aa, Homo sapiens
RLRLKTKQNKANEVNYFGKHIFWFPKGVLTNTHLRHRLKSVLKVYDGRRARLCPGTMSGSVPWCSLGVLMVVFPVSCTDQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPAICLRCVPGGGLDWHGSSVQKSQQGTGSSDVKARAVENGTQSRC

SEQ ID NO: 828310 - protein, 118 aa, Homo sapiens
AWTGMDPVCRRASREPEALMSRPEQLRMGPRVDADLGTPPFRGHHRDASRMPLCQPDTRTFVKNSNRQERQRVTRLCPVIGWHMLTSCQTTSTRVIHVHLQQPARYSLCDFSVCVCVS

SEQ ID NO: 828311 - protein, 244 aa, Homo sapiens
VGAPGRWRRRRRGSSVTGARPVKTLLAGATSLPAARNGNGVKGDPSTWPRGSAMELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPANEEVAVNPLPFSSGGCKRLQAEAE

SEQ ID NO: 828312 - protein, 141 aa, Homo sapiens; identical to SEQ ID NO: 828308

SEQ ID NO: 828313 - protein, 257 aa, Homo sapiens; identical to SEQ ID NO: 828304

SEQ ID NO: 828314 - protein, 127 aa, Homo sapiens; identical to SEQ ID NO: 828307

SEQ ID NO: 828315 - protein, 247 aa, Homo sapiens
RLRLKTKQNKANEVNYFGKHIFWFPKGVLTNTHLRHRLKSVLKVYDGRRARLCPGTMSGSVPWCSLGVLMVVFPVSCTDQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASSRAEKKAEPPPSKPTVAKTGLALIKDCCGATQCNIM

SEQ ID NO: 828316 - protein, 218 aa, Homo sapiens [sequence omitted]

SEQ ID NO: 828317 - protein, 223 aa, Homo sapiens
VGAPGRWRRRRRGSSVTGARPVKTLLAGATSLPAARNGNGVKGDPSTWPRGSAMELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPATPI

SEQ ID NO: 828318 - protein, 2627 aa, Homo sapiens
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLPSLKSTVSASPLFQSLQISHMTQADLYRVNNSNCLLSEPPSWRAQHFSKGLDLSTCPIALKSISATETAQEATLGRWFDSEEKKGAETQMPSYSLSLGEEEEVEDLAVKLTSGDSESHPEPTDHVLQEKKMALLSLLCSTLVSEVNMNNTSDPTLAAIFEICRELALLEPEFILKASLYARQQLNVRNVANNILAIAAFLPACRPHLRRYFCAIVQLPSDWIQVAELYQSLAEGDKNKLVPLPACLRTAMTDKFAQFDEYQLAKYNPRKHRAKRHPRRPPRSPGMEPPFSHRCFPRYIGFLREEQRKFEKAGDTVSEKKNPPRFTLKKLVQRLHIHKPAQHVQALLGYRYPSNLQLFSRSRLPGPWDSSRAGKRMKLSRPETWERELSLRGNKASVWEELIENGKLPFMAMLRNLCNLLRVGISSRHHELILQRLQHGKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAACRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQQLMLPHGRLSLVTGQSGQGKTAFLASLVSALQAPDGAKVAPLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 828319 - protein, 94 aa, Homo sapiens
AALLDPTLSPESCQMRLLLVKRESGRPLYLRLVTDHLRLFTLYEQVSERLRTLPPPPPSLSLNCLLRPQGNQCNPNPGPQPPNHDPQALTTPCD

SEQ ID NO: 828320 - protein, 2116 aa, Homo sapiens
MKLSRPETWERELSLRGNKASVWEELIENGKLPFMAMLRNLCNLLRVGISSRHHELILQRLQHGKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAACRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQQLMLPHGRLSLVTGQSGQGKTAFLASLVSALQAPDGAKVAPLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 828321 - protein, 2108 aa, Homo sapiens
MKLSRPETWERELSLRGNKASVWEELIENGKLPFMAMLRNLCNLLRVGISSRHHELILQRLQHGKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAACRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQQLMLPHGRLSLVTGQSGQGKTAFLASLVSALQAPDGAKVAPLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 828322 - protein, 231 aa, Homo sapiens
MKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 828323 - protein, 1848 aa, Homo sapiens
MKLSRPETWERELSLRGNKASVWEELIENGKLPFMAMLRNLCNLLRVGISSRHHELILQRLQHGKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAACRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQQLMLPHGRLSLVTGQSGQGKTAFLASLVSALQAPDGAKVAPLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLR

SEQ ID NO: 828324 - protein, 710 aa, Homo sapiens
MKLSRPETWERELSLRGNKASVWEELIENGKLPFMAMLRNLCNLLRVGISSRHHELILQRLQHGKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAACRISELKSYLSRQKGITCRRYPCEWGGVAAGRPYVGGLEEFGQLVLQDVWNMIQKLYLQPGALLEQPVSIPDDDLVQATFQQLQKPPSPARPRPANFIFLVEMGFHHVGHAGLELLTIGDPPTSASQSAGITDVSHCAWPTNHCS

SEQ ID NO: 828325 - protein, 55 aa, Homo sapiens
FHPEGQVIATGSWAGSISFFQVDGLKVTKVRRSSVALGGSTGGQEWRVADDRQQH

SEQ ID NO: 828326 - protein, 225 aa, Homo sapiens
MPGLLGFPKGTALRNPVPPPLPPPSQRVIRSRSQSMDAMGLSNKKPNTVSTSHSGSFAPNNPDLAKAAGILSALPLPRPRPLPGGPSALLCLLRPDSNSLCCPAAHMPILGSGFGLATTFHGRGVKCPGQDTAVLTACSLQPLPKLLGPPLLLALYALRCDFLQVSPGTASVSHSLLSIYLFAGDWAAVWAPTVKPWVSGSTYCVSGCGHPLCVRPWAAVWTCTL

SEQ ID NO: 828327 - protein, 1063 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVCARESPLPSWGLFPFRKLGGCLWEWISSLVLSCSSTLLQGLGQQDPQRGCGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828328 - protein, 1783 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGILSALPLPRPRPLPGGPSALLCLLRPDSNSLCCPAAHMPILGSGFGLATTFHGRGVKCPGQDTAVLTACSLQPLPKLLGPPLLLALYALRCDFLQVSPGTASVSHSLLSIYLFAGDWAAVWAPTVKPWVSGSTYCVSGCGQPTVCQALGCCVDMHSVSIYCGPGPEYLGAPTVCQVLGCCVGINSVSAYCVRSPGLLCENLTVCQKMDCYVSTSCVISPRCQGTPTVCQEVSCCVGTFSVSTSYCVSAAARASVVWLPIVCRESGFCVSISRGSTSCVITDCCPGSGILLLTLRSAGHMDEYGLMAVGLTAVHCLVATPGHCTHCCAPHPSIQPPIHPPTHPSIHPPIHPSSYPPTHPCTHLPIYPSTHPPTHPSTHPSTHPSTHECHPCTHPSQPSIHASIHPSIHPSMCIHPCISIHPSTHPPIHPSIHPSFIDCLLHAKPCAQCCEAMSRGRREFPDLCCPAVTKHTVMRGAGPTSPNPVLSTTPFLSTRVTQPPVGGREGPQGQDQASSTHHGSNRTHFCFVFAQLSLSLCFLLSFYSLSLFFCSLLPSLSPSCGLSALWLSVSPSFLHLSFFAPSPPSLLRSSHPRFFLSAFPWLPSLSLTLPGPVSVSLRPCLSGFPSVPIWCALAGSRVSLSPGNCLSISPPSPLSSVSPCASRLPFPGPISPIASCTVLFLFLSVFLLSLPLLLSVSPSHHLSCSLTLSLSLSLCPRPLLLCQSLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVCARESPLPSWGLFPFRKLGGCLWEWISSLVLSCSSTLLQGLGQQDPQRGCGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828329 - protein, 815 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828330 - protein, 996 aa, Homo sapiens
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVELGRAPCPPGDCFPFVNWEAVSGNGYLLSFFLAHQLCFRAWGSRIPRGDVGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828331 - protein, 1064 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVCARESPLPSWGLFPFRKLGGCLWEWISSLVLSCSSTLLQGLGQQDPQRGCGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPVRWLPPAPLPRPLSITPPRRRQVGGPCVSRDQDPAGSI

SEQ ID NO: 828332 - protein, 1109 aa, Homo sapiens
ISTAVERRKGERRGGVVHVDLLPLCCQEVNTSANRGHPPSDPHSEEADPSSNSDIATEQPYNFWVDKSFTSRRSVWRSDGQNQHFPQALDLSRVNLVPSYTPSLYPKNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVCARESPLPSWGLFPFRKLGGCLWEWISSLVLSCSSTLLQGLGQQDPQRGCGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828333 - protein, 914 aa, Homo sapiens
MLSLTHSPGPHLPLQEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALQPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVCARESPLPSWGLFPFRKLGGCLWEWISSLVLSCSSTLLQGLGQQDPQRGCGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828334 - protein, 852 aa, Homo sapiens
AELQRRPRAPECRAQDAPGPGPWGLVPAAGRLGLGKKPCVRTPAHTHSLRRLIPLPTEATTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVELGRAPCPPGDCFPFVNWEAVSGNGYLLSFFLAHQLCFRAWGSRIPRGDVGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828335 - protein, 1367 aa, Homo sapiens
LLHTGSFQGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGILSALPLPRPRPLPGGPSALLCLLRPDSNSLCCPAAHMPILGSGFGLATTFHGRGVKCPGQDTAVLTACSLQPLPKLLGPPLLLALYALRCDFLQVSPGTASVSHSLLSIYLFAGDWAAVWAPTVKPWVSGSTYCVSGCGQPTVCQALGCCVDMHSVSIYCGPGPEYLGAPTVCQVLGCCVGINSVSAYCVRSPGLLCENLTVCQKMDCYVSTSCVISPRCQGTPTVCQEVSCCVGTFSVSTSYCVSAAARASVVWLPIVCRESGFCVSISRGSTSCVITDCCPGSGILLLTLRSAGHMDEYGLMAVGLTAVHCLVATPGHCTHCCAPHPSIQPPIHPPTHPSIHPPIHPSSYPPTHPCTHLPIYPSTHPPTHPSTHPSTHPSTHECHPCTHPSQPSIHASIHPSIHPSMCIHPCISIHPSTHPPIHPSIHPSFIDCLLHAKPCAQCCEAMSRGRREFPDLCCPAVTKHTVMRGAGPTSPNPVLSTTPFLSTRVTQPPVGGREGPQGQDQASSTHHGSNRTHFCFVFAQLSLSLCFLLSFYSLSLFFCSLLPSLSPSCGLSALWLSVSPSFLHLSFFAPSPPSLLRSSHPRFFLSAFPWLPSLSLTLPGPVSVSLRPCLSGFPSVPIWCALAGSRVSLSPGNCLSISPPSPLSSVSPCASRLPFPGPISPIASCTVLFLFLSVFLLSLPLLLSVSPSHHLSCSLTLSLSLSLCPRPLLLCQSLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVCARESPLPSWGLFPFRKLGGCLWEWISSLVLSCSSTLLQGLGQQDPQRGCGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828336 - protein, 98 aa, Homo sapiens
GSSVIEVGSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828337 - protein, 843 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPDAGKLGDPACPEIKIQLEASEQHMPQLGCSRGNPSEGETGQGGTEAQGERCRGKAQGDTPSGLKTTPRRWDLPGHSPRNHGNTKGGIAGTRRNNGQSEQTDSHPPMIGAEPARKQAAKHRDPRKKNKKQHRQKGEKENRQKQREEENDKK

SEQ ID NO: 828338 - protein, 252 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKVWLDLGTAH

SEQ ID NO: 828339 - protein, 735 aa, Homo sapiens
QSCSGGRGHQSAEPRTPPAQALGVDKSFTSRRSVWRSDGQNQHFPQALDLSRVNLVPSYTPSLYPKNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828340 - protein, 149 aa, Homo sapiens
SRAAAAAAGTRVPSPGRPRPRPLGFGASCGAPGLGEETLCTHTCTHTQSPEVNTSANRGHPPSDPHSEEADPSSNSDIATEQPYNFWVDKSFTSRRSVWRSDGQNQHFPQALDLSRVNLVPSYTPSLYPKLFHLLEPASHLYNGDDICT

SEQ ID NO: 828341 - protein, 1104 aa, Homo sapiens
AELQRRPRAPECRAQDAPGPGPWVNTSANRGHPPSDPHSEEADPSSNSDIATEQPYNFWVDKSFTSRRSVWRSDGQNQHFPQALDLSRVNLVPSYTPSLYPKNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVELGRAPCPPGDCFPFVNWEAVSGNGYLLSFFLAHQLCFRAWGSRIPRGDVGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828342 - protein, 756 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEESLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828343 - protein, 1065 aa, Homo sapiens
GGGGTMSGRKRSFTFGAYGGVDKSFTSRRSVWRSDGQNQHFPQALDLSRVNLVPSYTPSLYPKNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVELGRAPCPPGDCFPFVNWEAVSGNGYLLSFFLAHQLCFRAWGSRIPRGDVGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828344 - protein, 1055 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVCARESPLPSWGLFPFRKLGGCLWEWISSLVLSCSSTLLQGLGQQDPQRGCGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPDAGKLGDPACPEIKIQLEASEQHMPQLGC

SEQ ID NO: 828345 - protein, 1006 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPIFLPTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVCARESPLPSWGLFPFRKLGGCLWEWISSLVLSCSSTLLQGLGQQDPQRGCGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828346 - protein, 823 aa, Homo sapiens
MIPVCVGVWFWVGLVRGSCFSPVWFSCGSVLTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLVPVPEPVPLTRGFWPCLGPWDPGPVPARIRYPKALTPSRTSPNIAGLHGAPSLSSALTPPPRHEVTWGPTPSCLQRSWGRASGAWGIPAQCVGSWGSLPAAGPEPPPANLEVPGRGPSWHGVGLGLLHCPLTTALRLQIPQSPGGRGAVAILRTRPPPTLAPSGCCPNPGPVLTCSPAVELGRAPCPPGDCFPFVNWEAVSGNGYLLSFFLAHQLCFRAWGSRIPRGDVGGALGLPGKVALSWGLSPQSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 828347 - protein, 364 aa, Homo sapiens
KQAVTGRGFEGGLAQEGLGVDTGYWGTVCGRAETAAQRAEALKDFSRSSSSASSFASVVEETEGVDGEDTGLESVSSSGTPHKRDSFIYSTWLEDSVSTTSGGSSPGTRTRQLPHKAGLPWGRRGTGLGTSSHAPCSGCDVTAPDLEDSGQVIVQPRVAGWIGGLVSSGRVSEDNGEMARKKVKGGVGAHWCRPPTYAPVSLVPPRGQCEVAPSCPPPQAPLDHPTQTPASWGTLRVPRSRSSWKHLSSTCPSWAVSRATPSEGETEQMRPQKHKGKVPCQAQADETSALKTNTSPWAAPCLPTLPMAHPSGLSLQGRAVQTWDQGSCWHRPHPQPGGLGWGRDCSVEAGLGVWLAPSLGLHHP

SEQ ID NO: 828348 - protein, 555 aa, Homo sapiens
RGAQRCGARTRARAGQEPAGPAEVPPGRGPGRAALRMAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKAGHPEPQPVHGCHGAEQQEAQHRVHQPQRELRAQQPRPGQGGWNTAGSPCVSGHTF

SEQ ID NO: 828349 - protein, 60 aa, Homo sapiens
MTAVGAERLTSVRAWLSCCGACVCVFLFLCLCVFPLRVHVHVWGGECRVDIAVFVSKHMI

SEQ ID NO: 828350 - protein, 196 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRSDEHVRTELARMKQEPVRTDDGRAMAVRIQAYDYLECSAKTKEGVREVFETATRAALQKRYGSQNGCINCCKVL

SEQ ID NO: 828351 - protein, 196 aa, Homo sapiens; identical to SEQ ID NO: 828350

SEQ ID NO: 828352 - protein, 196 aa, Homo sapiens; identical to SEQ ID NO: 828350

SEQ ID NO: 828353 - protein, 196 aa, Homo sapiens; identical to SEQ ID NO: 828350

SEQ ID NO: 828354 - protein, 196 aa, Homo sapiens; identical to SEQ ID NO: 828350

SEQ ID NO: 828355 - protein, 196 aa, Homo sapiens; identical to SEQ ID NO: 828350

SEQ ID NO: 828356 - protein, 196 aa, Homo sapiens; identical to SEQ ID NO: 828350

SEQ ID NO: 828357 - protein, 196 aa, Homo sapiens; identical to SEQ ID NO: 828350

SEQ ID NO: 828358 - protein, 205 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRRSALPRPRKACARSSRRPRAPRCRSATAPRTAASTAARCYEGRARRACPCRHGSPSWTSPPRARRRGDPCPTRTPPACLASVC

SEQ ID NO: 828359 - protein, 208 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKQNPCARMTAAPWPCASKPTTTSSALPRPRKACARSSRRPRAPRCRSATAPRTAASTAARCYEGRARRACPCRHGSPSWTSPPRARRRGDPCPTRTPPACLASVC

SEQ ID NO: 828360 - protein, 223 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPGVLCQDQGRRARGLRDGHARRAAEALRLPERLHQLLQGAMRAAPVAPAPAGTAPPPGPVPREPGEGETRVPQGPHRPAWHLSADASGLRQDLAWAPGAPIPVSVCVQLCCTGLGSPLSAKGPLSMLF

SEQ ID NO: 828361 - protein, 134 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRRSSCVAQAWAPH

SEQ ID NO: 828362 - protein, 196 aa, Homo sapiens; identical to SEQ ID NO: 828350

SEQ ID NO: 828363 - protein, 196 aa, Homo sapiens; identical to SEQ ID NO: 828350

SEQ ID NO: 828364 - protein, 196 aa, Homo sapiens; identical to SEQ ID NO: 828350

SEQ ID NO: 828365 - protein, 196 aa, Homo sapiens; identical to SEQ ID NO: 828350

SEQ ID NO: 828366 - protein, 229 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRSDEHVRTELARMKQEPVRTDDGRAMAVRIQAYDYLECSAKTKEGVREVFETATRAALQKRYGSQNGCINDLGRTQLQHSLSCGPARCEPSTSYRREEGGCAVGLFLP

SEQ ID NO: 828367 - protein, 153 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRRPAANPPPATGGRREDALWGCFCHKRTLCLS

SEQ ID NO: 828368 - protein, 196 aa, Homo sapiens; identical to SEQ ID NO: 828350

SEQ ID NO: 828369 - protein, 196 aa, Homo sapiens; identical to SEQ ID NO: 828350

SEQ ID NO: 828370 - protein, 196 aa, Homo sapiens; identical to SEQ ID NO: 828350

SEQ ID NO: 828371 - protein, 115 aa, Homo sapiens
MCFSVDSPDSLENIPEKWVPEVKHFCPNVPIILVANKKDLRSDEHVRTELARMKQEPVRTDDGRAMAVRIQAYDYLECSAKTKEGVREVFETATRAALQKRYGSQNGCINCCKVL

SEQ ID NO: 828372 - protein, 127 aa, Homo sapiens
MRILMLFLLCFSCCDIPYSLDNISLYNEKWVPEVKHFCPNVPIILVANKKDLRSDEHVRTELARMKQEPVRTDDGRAMAVRIQAYDYLECSAKTKEGVREVFETATRAALQKRYGSQNGCINCCKVL

SEQ ID NO: 828373 - protein, 140 aa, Homo sapiens
RRADLPPQSGWSCCLVCSARPGETRERARPSPPPESAARARVTHKAADPRPGVSRATTATSGSLISLVCNIDPGYCGRGGLLGRMGGCYINIDIILFSELRWCYLRVVMGERSGPGWARLPPKHEQDLTIFPTPGEDICN

SEQ ID NO: 828374 - protein, 196 aa, Homo sapiens; identical to SEQ ID NO: 828350

SEQ ID NO: 828375 - protein, 150 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRSCGVVFAISELCACPRSENCSVQETDVI

SEQ ID NO: 828376 - protein, 196 aa, Homo sapiens; identical to SEQ ID NO: 828350

SEQ ID NO: 828377 - protein, 196 aa, Homo sapiens; identical to SEQ ID NO: 828350

SEQ ID NO: 828378 - protein, 115 aa, Homo sapiens; identical to SEQ ID NO: 828371

SEQ ID NO: 828379 - protein, 115 aa, Homo sapiens; identical to SEQ ID NO: 828371

SEQ ID NO: 828380 - protein, 703 aa, Homo sapiens
MEFVSGYRDEFLDFTALLFGWFRKFVAERGAVGTSLEGRCRQLEAQIRRLPQDPALWVLHVLPNHSVGISLGQGAEPGPGPGLGTAWLLGDNPPLHLRDLSPYISFVSLEDGEEGEEEEEEDEEEEKREDGGAGSTEKVEPEEDRELAPTSRESPQETNPPGESEEAAREAGGGKDGCREDRVENETRPQKRKGQRSEAAPLHVSCLLLVTDEHGTILGIDLLVDGAQGTASWGSGTKDLAPWAYALLCHSMACPMGSGDPRKPRQLTVGDARLHRELESLVPRLGVKLAKTPMRTWGPRPGFTFASLRARTCHVCHRHSFEAKLTPCPQCSAVLYCGEACLRADWQRCPDDVSHRFWCPRLAAFMERAGELATLPFTYTAEVTSETFNKEAFLASRGLTRGYWTQLSMLIPGPGFSRHPRGNTPSLSLLRGGDPYQLLQGDGTALMPPVPPHPPRGVFVPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 828381 - protein, 742 aa, Homo sapiens
MEFVSGYRDEFLDFTALLFGWFRKFVAERGAVGTSLEGRCRQLEAQIRRLPQDPALWVLHVLPNHSVGISLGQGAEPGPGPGLGTAWLLGDNPPLHLRDLSPYISFVSLEDGEEGEEEEEEDEEEEKREDGGAGSTEKVEPEEDRELAPTSRESPQETNPPGESEEAAREAGGGKDGCREDRVENETRPQKRKGQRSEAAPLHVSCLLLVTDEHGTILGIDLLVDGAQGTASWGSGTKDLAPWAYALLCHSMACPMGSGDPRKPRQLTVGDARLHRELESLVPRLGVKLAKTPMRTWGPRPGFTFASLRARTCHVCHRHSFEAKLTPCPQCSAVLYCGEACLRADWQRCPDDVSHRFWCPRLAAFMERAGELATLPFTYTAEVTSETFNKEAFLASRGLTRGYWTQLSMLIPGPGFSRHPRGNTPSLSLLRGGDPYQLLQGDGTALMPPVPPHPPRGVFGSWQDYYTWRGLSLDSPIAVLLTYPLTVYYVITHLVPQSFPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 828382 - protein, 316 aa, Homo sapiens
PSFILSGDPYQLLQGDGTALMPPVPPHPPRGVFGSWQDYYTWRGLSLDSPIAVLLTYPLTVYYVITHLVPQSFPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 828383 - protein, 766 aa, Homo sapiens
VSIPLRVSIPLRVSIRFVCPSPFVMEFVSGYRDEFLDFTALLFGWFRKFVAERGAVGTSLEGRCRQLEAQIRRLPQDPALWVLHVLPNHSVGISLGQGAEPGPGPGLGTAWLLGDNPPLHLRDLSPYISFVSLEDGEEGEEEEEEDEEEEKREDGGAGSTEKVEPEEDRELAPTSRESPQETNPPGESEEAAREAGGGKDGCREDRVENETRPQKRKGQRSEAAPLHVSCLLLVTDEHGTILGIDLLVDGAQGTASWGSGTKDLAPWAYALLCHSMACPMGSGDPRKPRQLTVGDARLHRELESLVPRLGVKLAKTPMRTWGPRPGFTFASLRARTCHVCHRHSFEAKLTPCPQCSAVLYCGEACLRADWQRCPDDVSHRFWCPRLAAFMERAGELATLPFTYTAEVTSETFNKEAFLASRGLTRGYWTQLSMLIPGPGFSRHPRGNTPSLSLLRGGDPYQLLQGDGTALMPPVPPHPPRGVFGSWQDYYTWRGLSLDSPIAVLLTYPLTVYYVITHLVPQSFPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 828384 - protein, 887 aa, Homo sapiens
MPILLFLIDTSASMNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 828385 - protein, 310 aa, Homo sapiens
RAGAASRVRPGPGLRPRAVCGERSVCGGRRGGVAAACAVLWGRRGRWAPLLRLVTSPLCFPVARPVPPPVPQLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTGGVHIPGGLHRMLNRSGDPGGKSPHGGDKLWKNRANLPGENGRQYKGLETTGNGDTILTTSKGHKTGAQLEK

SEQ ID NO: 828386 - protein, 186 aa, Homo sapiens
RAGAASRVRPGPGLRPRAVCGERSVCGGRRGGVAAACAVLWGRRGRWAPLLRLVTSPLCFPVARPVPPPVPQLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDEVLGTHRWN

SEQ ID NO: 828387 - protein, 887 aa, Homo sapiens; identical to SEQ ID NO: 828384

SEQ ID NO: 828388 - protein, 887 aa, Homo sapiens; identical to SEQ ID NO: 828384

SEQ ID NO: 828389 - protein, 887 aa, Homo sapiens; identical to SEQ ID NO: 828384

SEQ ID NO: 828390 - protein, 709 aa, Homo sapiens
MSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 828391 - protein, 874 aa, Homo sapiens
MNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 828392 - protein, 922 aa, Homo sapiens
RAGAASRVRPGPGLRPRAVCGERSVCGGRRGGVAAACAVLWGRRGRWAPLLRLVTSPLCFPVARPVPPPVPQLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 828393 - protein, 709 aa, Homo sapiens; identical to SEQ ID NO: 828390

SEQ ID NO: 828394 - protein, 571 aa, Homo sapiens
MVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 828395 - protein, 571 aa, Homo sapiens; identical to SEQ ID NO: 828394

SEQ ID NO: 828396 - protein, 571 aa, Homo sapiens; identical to SEQ ID NO: 828394

SEQ ID NO: 828397 - protein, 151 aa, Homo sapiens
MPILLFLIDTSASMNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDEVLGTHRWN

SEQ ID NO: 828398 - protein, 151 aa, Homo sapiens; identical to SEQ ID NO: 828397

SEQ ID NO: 828399 - protein, 68 aa, Homo sapiens
MPILLFLIDTSASMNQRSHLGTTYLDTAKGAVETFMKVPTDRARAATPARRPAGGRVGEGGRGGGVGD

SEQ ID NO: 828400 - protein, 186 aa, Homo sapiens; identical to SEQ ID NO: 828386

SEQ ID NO: 828401 - protein, 1772 aa, Homo sapiens
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLQYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLEVIKEDAAEGLSSPTDSSRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 828402 - protein, 1031 aa, Homo sapiens
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLQYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERCCGADSCDRDRIGISKSVLVAMLMES

SEQ ID NO: 828403 - protein, 1753 aa, Homo sapiens
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLQYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 828404 - protein, 1410 aa, Homo sapiens
MKIVTVCILYIKIRKFKFRTIILQKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 828405 - protein, 543 aa, Homo sapiens
MLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 828406 - protein, 1753 aa, Homo sapiens; identical to SEQ ID NO: 828403

SEQ ID NO: 828407 - protein, 1199 aa, Homo sapiens
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLQYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLEVIKEDAAEGLSSPTDSSRVME

SEQ ID NO: 828408 - protein, 1125 aa, Homo sapiens
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLQYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAVKCEWTSDHLFF

SEQ ID NO: 828409 - protein, 1067 aa, Homo sapiens
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLQYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIAGGY

SEQ ID NO: 828410 - protein, 243 aa, Homo sapiens
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAGNNMNRKNTPYQQGTPCAGCPDDCDKGLCTNSCQYQDLLSNCDSLKNTAGCEHELLKEKCKATCLCENKIY

SEQ ID NO: 828411 - protein, 243 aa, Homo sapiens; identical to SEQ ID NO: 828410

SEQ ID NO: 828412 - protein, 191 aa, Homo sapiens
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAMKTYLNKREGINVWKCFLR

SEQ ID NO: 828413 - protein, 243 aa, Homo sapiens; identical to SEQ ID NO: 828410

SEQ ID NO: 828414 - protein, 243 aa, Homo sapiens; identical to SEQ ID NO: 828410

SEQ ID NO: 828415 - protein, 243 aa, Homo sapiens; identical to SEQ ID NO: 828410

SEQ ID NO: 828416 - protein, 243 aa, Homo sapiens; identical to SEQ ID NO: 828410

SEQ ID NO: 828417 - protein, 243 aa, Homo sapiens; identical to SEQ ID NO: 828410

SEQ ID NO: 828418 - protein, 208 aa, Homo sapiens
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAGNNMNRKNTPYQQGTPCAGCPDDCDKGLCSSTYQQN

SEQ ID NO: 828419 - protein, 243 aa, Homo sapiens; identical to SEQ ID NO: 828410

SEQ ID NO: 828420 - protein, 132 aa, Homo sapiens
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNW

SEQ ID NO: 828421 - protein, 243 aa, Homo sapiens; identical to SEQ ID NO: 828410

SEQ ID NO: 828422 - protein, 48 aa, Homo sapiens
MYFLTVLEAQSKVKVLPALVSSGAFLLRSQMAVFWMPLLVIVQLYTCL

SEQ ID NO: 828423 - protein, 108 aa, Homo sapiens
MNKTHKDCSSPQYSIYNILNELPTRPIILSCSQISCLLLVSTWSADLMSYRPVTKPSQRCTSPAQSMTVNLTKDVGFYEDTQSIRITLSEISQAQKDTYFIISCICGI

SEQ ID NO: 828424 - protein, 367 aa, Homo sapiens
TNQRAGWSAGLPLWTHMRAVLAGEMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLDEALLRRLHLTPSQAAQLPLHLHLHRLLLPGTRARDTPVELLAPLPPYFSRTLQCLGLRLQ

SEQ ID NO: 828425 - protein, 367 aa, Homo sapiens; identical to SEQ ID NO: 828424

SEQ ID NO: 828426 - protein, 319 aa, Homo sapiens
TNQRAGWSAGLPLWTHMRAVLAGEMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQNSPPSVPDPLTHTGK

SEQ ID NO: 828427 - protein, 320 aa, Homo sapiens [sequence omitted]

SEQ ID NO: 828428 - protein, 266 aa, Homo sapiens
TNQRAGWSAGLPLWTHMRAVLAGEMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTGRSGTLASL

SEQ ID NO: 828429 - protein, 127 aa, Homo sapiens
MQKPGKTSPKANLRLDNVSWGSCKHCDLRNNRWHQRQPRGSCQRSGPLGDQPFAGLLPKNLSREELVDALRAAVVDRKGPLVTLNKPQGLPVTGKPGELTLFSVLPELSQSLGLREQELQVVRASGK

SEQ ID NO: 828430 - protein, 163 aa, Homo sapiens
TNQRAGWSAGLPLWTHMRAVLAGEMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKSWMKPSSDAST

SEQ ID NO: 828431 - protein, 82 aa, Homo sapiens
QSARWLERGSAPLDAHARCPGWGDGRPPCFGPVLEWLAAGPGCPPSARGRRLWHRSPVIKYPLSHAGRRLGQGEGTCGIWIR

SEQ ID NO: 828432 - protein, 256 aa, Homo sapiens
MGPVVPEFSRHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLKFSEAIRRTLEVPETLSTSVVAKAGGLVKEHAGPSTRAMPKAPGGPVAGRRPGWPKSQRGTRKTPGGAKGRGGGATQGTAQGHRGLRT

SEQ ID NO: 828433 - protein, 152 aa, Homo sapiens
TNQRAGWSAGLPLWTHMRAVLAGEMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGK

SEQ ID NO: 828434 - protein, 367 aa, Homo sapiens; identical to SEQ ID NO: 828424

SEQ ID NO: 828435 - protein, 266 aa, Homo sapiens; identical to SEQ ID NO: 828428

SEQ ID NO: 828436 - protein, 349 aa, Homo sapiens
TNQRAGWSAGLPLWTHMRAVLAGEMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTVGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLDEALLRRLHLTPSQAAQLPLHLHLHRLLLPGTRARDTPVELLAPLPPYFSRTLQCLGLRLQ

SEQ ID NO: 828437 - protein, 152 aa, Homo sapiens; identical to SEQ ID NO: 828433

SEQ ID NO: 828438 - protein, 158 aa, Homo sapiens
TNQRAGWSAGLPLWTHMRAVLAGEMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKQSMTPP

SEQ ID NO: 828439 - protein, 162 aa, Homo sapiens
TNQRAGWSAGLPLWTHMRAVLAGEMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKWSYRLFCHPG

SEQ ID NO: 828440 - protein, 966 aa, Homo sapiens
WPPFIFGGGAPCLMWLWGPAAPGGRAASTGSEIPRVTPDDTPSSAKRKGWEKGGGAFGGNKMEGESSRFEIHTPVSDKKKKKCSIHKERPQKHSHEIFRDSSLVNEQSQITRRKKRKKDFQHLISSPLKKSRICDETANATSTLKKRKKRRYSALEVDEEAGVTVVLVDKENINNTPKHFRKDVDVVCVDMSIEQKLPRKPKTDKFQVLAKSHAHKSEALHSKVREKKNKKHQRKAASWESQRARDTLPQSESHQEESWLSVGPGGEITELPASAHKNKSKKKKKKSSNREYETLAMPEGSQAGREAGTDMQESQPTVGLDDETPQLLGPTHKKKSKKKKKKKSNHQEFEALAMPEGSQVGSEVGADMQESRPAVGLHGETAGIPAPAYKNKSKKKKKKSNHQEFEAVAMPESLESAYPEGSQVGSEVGTVEGSTALKGFKESNSTKKKSKKRKLTSVKRARVSGDDFSVPSKNSESTLFDSVEGDGAMMEEGVKSRPRQKKTQACLASKHVQEAPRLEPANEEHNVETAEDSEIRYLSADSGDADDSDADLGSAVKQLQEFIPNIKDRATSTIKRMYRDDLERFKEFKAQGVAIKFGKFSVKENKQLEKNVEDFLALTGIESADKLLYTDRYPEEKSVITNLKRRYSFRLHIGRNIARPWKLIYYRAKKMFDVNNYKGRYSEGDTEKLKMYHSLLGNDWKTIGEMVARSSLSVALKFSQISSQRNRGAWSKSETRKLIKAVEEVILKKMSPQELKEVDSKLQENPESCLSIVREKLYKGISWVEVEAKVQTRNWMQCKSKWTEILTKRMTNGRRIYYGMNALRAKVSLIERLYEINVEDTNEIDWEDLASAIGDVPPSYVQTKFSRLKAVYVPFWQKKTFPEIIDYLYETTLPLLKEKLEKMMEKKGTKIQTPAAPKQVFPFRDIFYYEDDSEGEDIEKESEGQAPCMAHACNSSTLGGQGRWII

SEQ ID NO: 828441 - protein, 681 aa, Homo sapiens
WPPFIFGGGAPCLMWLWGPAAPGGRAASTGSEIPRVTPDDTPSSAKRKGWEKGGGAFGGNKMEGESSRFEIHTPVSDKKKKKCSIHKERPQKHSHEIFRDSSLVNEQSQITRRKKRKKDFQHLISSPLKKSRICDETANATSTLKKRKKRRYSALEVDEEAGVTVVLVDKENINNTPKHFRKDVDVVCVDMSIEQKLPRKPKTDKFQVLAKSHAHKSEALHSKVREKKNKKHQRKAASWESQRARDTLPQSESHQEESWLSVGPGGEITELPASAHKNKSKKKKKKSSNREYETLAMPEGSQAGREAGTDMQESQPTVGLDDETPQLLGPTHKKKSKKKKKKKSNHQEFEALAMPEGSQVGSEVGADMQESRPAVGLHGETAGIPAPAYKNKSKKKKKKSNHQEFEAVAMPESLESAYPEGSQVGSEVGTVEGSTALKGFKESNSTKKKSKKRKLTSVKRARVSGDDFSVPSKNSESTLFDSVEGDGAMMEEGVKSRPRQKKTQACLASKHVQEAPRLEPANEEHNVETAEDSEIRYLSADSGDADDSDADLGSAVKQLQEFIPNIKDRATSTIKRMYRDDLERFKEFKAQGVAIKFGKFSVKENKQLEKNVEDFLALTGIESADKLLYTDRYPEEKSVITNLKRRYSFRLHIGRNIARPWKLIYYRAKKMFDVNNYKGRY

SEQ ID NO: 828442 - protein, 346 aa, Homo sapiens
SGGFIAYATCLPHVAKLAPVITNLNRRYSFTHIGRNIARPWKLIYYRAKKMFDVNNYKGRYSEGDTEKLKMYHSLLGNDWKTIGEMVARSSLSVALKFSQISSQRNRGAWSKSETRKLIKAVEEVILKKMSPQELKEVDSKLQENPESCLSIVREKLYKGISWVEVEAKVQTRNWMQCKSKWTEILTKRMTNGRRIYYGMNALRAKVSLIERLYEINVEDTNEIDWEDLASAIGDVPPSYVQTKFSRLKAVYVPFWQKKTFPEIIDYLYETTLPLLKEKLEKMMEKKGTKIQTPAAPKQVFPFRDIFYYEDDSEGEDIEKESEGQAPCMAHACNSSTLGGQGRWII

SEQ ID NO: 828443 - protein, 949 aa, Homo sapiens
WPPFIFGGGAPCLMWLWGPAAPGGRAASTGSEIPRVTPDDTPSSAKRKGWEKGGGAFGGNKMEGESSRFEIHTPVSDKKKKKCSIHKERPQKHSHEIFRDSSLVNEQSQITRRKKRKKDFQHLISSPLKKSRICDETANATSTLKKRKKRRYSALEVDEEAGVTVVLVDKENINNTPKHFRKDVDVVCVDMSIEQKLPRKPKTDKFQVLAKSHAHKSEALHSKVREKKNKKHQRKAASWESQRARDTLPQSESHQEESWLSVGPGGEITELPASAHKNKSKKKKKKSSNREYETLAMPEGSQAGREAGTDMQESQPTVGLDDETPQLLGPTHKKKSKKKKKKKSNHQEFEALAMPEGSQVGSEVGADMQESRPAVGLHGETAGIPAPAYKNKSKKKKKKSNHQEFEAVAMPESLESAYPEGSQVGSEVGTVEGSTALKGFKESNSTKKKSKKRKLTSVKRARVSGDDFSVPSKNSESTLFDSVEGDGAMMEEGVKSRPRQKKTQACLASKHVQEAPRLEPANEEHNVETAEDSEIRYLSADSGDADDSDADLGSAVKQLQEFIPNIKDRATSTIKRMYRDDLERFKEFKAQGVAIKFGKFSVKENKQLEKNVEDFLALTGIESADKLLYTDRYPEEKSVITNLKRRYSFRLHIGRNIARPWKLIYYRAKKMFDVNNYKGRYSEGDTEKLKMYHSLLGNDWKTIGEMVARSSLSVALKFSQISSQRNRGAWSKSETRKLIKAVEEVILKKMSPQELKEVDSKLQENPESCLSIVREKLYKGISWVEVEAKVQTRNWMQCKSKWTEILTKRMTNGRRIYYGMNALRAKVSLIERLYEINVEDTNEIDWEDLASAIGDVPPSYVQTKFSRLKAVYVPFWQKKTFPEIIDYLYETTLPLLKEKLEKMMEKKGTKIQTPAAPKQVFPFRDIFYYEDDSEGEDIEKESEGEFRKA

SEQ ID NO: 828444 - protein, 966 aa, Homo sapiens; identical to SEQ ID NO: 828440

SEQ ID NO: 828445 - protein, 458 aa, Homo sapiens
EKGGGAFGGLEPANEEHNVETAEDSEIRYLSADSGDADDSDADLGSAVKQLQEFIPNIKDRATSTIKRMYRDDLERFKEFKAQGVAIKFGKFSVKENKQLEKNVEDFLALTGIESADKLLYTDRYPEEKSVITNLKRRYSFRLHIGRNIARPWKLIYYRAKKMFDVNNYKGRYSEGDTEKLKMYHSLLGNDWKTIGEMVARSSLSVALKFSQISSQRNRGAWSKSETRKLIKAVEEVILKKMSPQELKEVDSKLQENPESCLSIVREKLYKGISWVEVEAKVQTRNWMQCKSKWTEILTKRMTNGRRIYYGMNALRAKVSLIERLYEINVEDTNEIDWEDLASAIGDVPPSYVQTKFSRLKAVYVPFWQKKTFPEIIDYLYETTLPLLKEKLEKMMEKKGTKIQTPAAPKQVFPFRDIFYYEDDSEGEDIEKESEGQAPCMAHACNSSTLGGQGRWII

SEQ ID NO: 828446 - protein, 444 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 828447 - protein, 471 aa, Homo sapiens
IAAPGGAGTVLRRLRRIFHPRRRRSSPRSCHRRRVHPQRHRHAGDRAPAGRPVRQPDRGQGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 828448 - protein, 368 aa, Homo sapiens
CSCRDRSDLSAGQLRVCQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 828449 - protein, 444 aa, Homo sapiens; identical to SEQ ID NO: 828446

SEQ ID NO: 828450 - protein, 444 aa, Homo sapiens; identical to SEQ ID NO: 828446

SEQ ID NO: 828451 - protein, 444 aa, Homo sapiens; identical to SEQ ID NO: 828446

SEQ ID NO: 828452 - protein, 246 aa, Homo sapiens
DAEVIQRIPTHQRRLFDKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 828453 - protein, 444 aa, Homo sapiens; identical to SEQ ID NO: 828446

SEQ ID NO: 828454 - protein, 444 aa, Homo sapiens; identical to SEQ ID NO: 828446

SEQ ID NO: 828455 - protein, 76 aa, Homo sapiens
RRLSASSSNSPSSAVTMVGARFTSGYFISDPGSPLSPNLSLTPLSSSNLDIPRRSPASPLLTLETAPLTLQTFLHP

SEQ ID NO: 828456 - protein, 255 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRSIAWGDHLVCYCRL

SEQ ID NO: 828457 - protein, 227 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLWYTTHVELCKLV

SEQ ID NO: 828458 - protein, 230 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLSWAGWAVSGVSSLTF

SEQ ID NO: 828459 - protein, 117 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGPHQFLTLY

SEQ ID NO: 828460 - protein, 444 aa, Homo sapiens; identical to SEQ ID NO: 828446

SEQ ID NO: 828461 - protein, 416 aa, Homo sapiens
MSRIGKSTETEIRSEVARINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 828462 - protein, 444 aa, Homo sapiens; identical to SEQ ID NO: 828446

SEQ ID NO: 828463 - protein, 373 aa, Homo sapiens
MADSRGYTALPSGTKAEGVEPNSSKLQLNLFRLRPYVAAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 828464 - protein, 444 aa, Homo sapiens; identical to SEQ ID NO: 828446

SEQ ID NO: 828465 - protein, 221 aa, Homo sapiens
HPRVLSCEWICPHPAPQRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 828466 - protein, 96 aa, Homo sapiens
IERLPGAQGPCSAVSAASSTLAAAAAPRARATAAASTLSATAMREIVHLQAGQCGNQIGAKFWEVISDEHGIDPTGTYHGDSDLQLERINPPISEP

SEQ ID NO: 828467 - protein, 112 aa, Homo sapiens
RRSLALLPRLQCSGTMSAHCKFRLLGSRHSPASASRVARTTGARHHSRLIFFEEPRFTPSHSGNRTFNFADLPSPLTSASPLTSAPHESHFTSRPISSGLCLTPPSELALHR

SEQ ID NO: 828468 - protein, 105 aa, Homo sapiens
MLFRGPASVFPVYSEESSQIEPLPVSCPSQASLSLHLCGFFYPEYTCHDSNFSFTLYESHFTSTPASPGLYWTPPSELQFTFDLASPFTPHPPQRQLLPLTPASL

SEQ ID NO: 828469 - protein, 96 aa, Homo sapiens; identical to SEQ ID NO: 828466

SEQ ID NO: 828470 - protein, 209 aa, Homo sapiens
SRVRHAQQPIPTRVCKVSDLHEGHFYEFRARAANWAGVGELSAPSSLFECKEWTMPQPGPPYDVRASEVRATSLVLQWEPPLYMGAGPVTGYHVSFQEEGSEQWKPVTPGPISGTHLRVSDLQPGKSYVFQVQAMNSAGLGQPSMPTDPVLLEDKPGAHEIEVGVDEEGFIYLAFEAPEAPDSSEFQWSKDYKGPLDPQRVKIEDKVNK

SEQ ID NO: 828471 - protein, 600 aa, Homo sapiens
MTAAPASPQQIRDRLLQAIDPQSNIRNMVAVLEVISSLEKYPITKEALEETRLGKLINDVRKKTKNEELAKRAKKLLRSWQKLIEPAHQHEAALRGLAGATGSANGGAHNCRPEVGAAGPPRSIHDLKSRNDLQRLPGQRLDRLGSRKRRGDQRDLGHPGPPPKVSKASHDPLVPNSSPLPTNGISGSPESFASSLDGSGHAGPEGSRLERDENDKHSGKIPVNAVRPHTSSPGLGKPPGPCLQPKASVLQQLDRVDETPGPPHPKGPPRCSFSPRNSRHEGSFARQQSLYAPKGSVPSPSPRPQALDATQVPSPLPLAQPSTPPVRRLELLPSAESPVCWLEQPESHQRLAGPGCKAGLSPAEPLLSRAGFSPDSSKADSDAASSGGSDSKKKKRYRPRDYTVNLDGQVAEAGVKPVRLKERKLTFDPMTRQIKPLTQKEPVRADSPVHMEQQSRTELDKQEAKASLQSPFEQTNWKELSRNEIIQSYLSRQSSLLSSSGAQTPGAHHFMSEYLKQEESTRQGARQLHVLVPQSPPTDLPGLTREVTQDDLDRIQASQWPGVNGCQDTQGNWYDWTQCISLDPHGDDGRLNILPYVCLD

SEQ ID NO: 828472 - protein, 756 aa, Homo sapiens
SRGSLPVGGRGDCAPTRDGGNDCRLGEGALRRPEMPLNFRQIGGPAPKTERSRPNASGAEVEKPPRRRRFATSGFPSYGGRLLPEALCRLTFSRSGSRVAVQTPALPPHPFPHPLRGGGAAATPPDSDDPSARRITTWTSGSLALTKNSAAAQPATPVPQSRAGKALPEEGFSRRPPRPEIRNMVAVLEVISSLEKYPITKEALEETRLGKLINDVRKKTKNEELAKRAKKLLRSWQKLIEPAHQHEAALRGLAGATGSANGGAHNCRPEVGAAGPPRSIHDLKSRNDLQRLPGQRLDRLGSRKRRGDQRDLGHPGPPPKVSKASHDPLVPNSSPLPTNGISGSPESFASSLDGSGHAGPEGSRLERDENDKHSGKIPVNAVRPHTSSPGLGKPPGPCLQPKASVLQQLDRVDETPGPPHPKGPPRCSFSPRNSRHEGSFARQQSLYAPKGSVPSPSPRPQALDATQVPSPLPLAQPSTPPVRRLELLPSAESPVCWLEQPESHQRLAGPGCKAGLSPAEPLLSRAGFSPDSSKADSDAASSGGSDSKKKKRYRPRDYTVNLDGQVAEAGVKPVRLKERKLTFDPMTRQIKPLTQKEPVRADSPVHMEQQSRTELDKQEAKASLQSPFEQTNWKELSRNEIIQSYLSRQSSLLSSSGAQTPGAHHFMSEYLKQEESTRQGARQLHVLVPQSPPTDLPGLTREVTQDDLDRIQASQWPGVNGCQDTQGNWYDWTQCISLDPHGDDGRLNILPYVCLD

SEQ ID NO: 828473 - protein, 600 aa, Homo sapiens; identical to SEQ ID NO: 828471

SEQ ID NO: 828474 - protein, 386 aa, Homo sapiens
WKIISGSPPEQALSEASFQDPCVEMPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSDPNHQRTHTGEKPYKCSECGKAFSQSTNLIIHQKTHTGEKPYKCNECGKFFSESSALIRHHIIHTGEKPYECNECGKAFNQSSSLSQHQRIHTGVKPYECSECGKAFRCSSAFVRHQRLHAGE

SEQ ID NO: 828475 - protein, 368 aa, Homo sapiens
WKIISGSPPEQALSEASFQDPCVEMPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSDPNHQRTHTGEKPYKCSECGKAFSQSTNLIIHQKTHTGEKPYKCNECGKFFSESSALIRHHIIHTGDSQHQRIHTGVKPYECSECGKAFRCSSAFVRHQRLHAGE

SEQ ID NO: 828476 - protein, 66 aa, Homo sapiens
AEVGEEEEELEGEEEEGEQEEGQKEEEEGEEKEIEEESHELAGYTEMSRGRRAFQITCTGWQLWLW

SEQ ID NO: 828477 - protein, 204 aa, Homo sapiens
MASVSSATFSGHGARSLLQFLRLVGQLKRVPRTGWVYRNVQRPESVSDHMYRMAVMAMVIKDDRLNKDRCVRLALVHDMAECIVGDIAPADNIPKEEKHRREEEAMKQITQLLPEDLRKELYELWEEYETQSSAEAKFVKQLDQCEMILQASEYEDLEHKPGRLQDFYDSTAGKFNHPEIVQLVSELEAERSTNIAAAASEPHS

SEQ ID NO: 828478 - protein, 210 aa, Homo sapiens
CGRALPTVDGGSSRRDRLASWGGPESEPRAWRRERVPRTGWVYRNVQRPESVSDHMYRMAVMAMVIKDDRLNKDRCVRLALVHDMAECIVGDIAPADNIPKEEKHRREEEAMKQITQLLPEDLRKELYELWEEYETQSSAEAKFVKQLDQCEMILQASEYEDLEHKPGRLQDFYDSTAGKFNHPEIVQLVSELEAERSTNIAAAASEPHS

SEQ ID NO: 828479 - protein, 204 aa, Homo sapiens; identical to SEQ ID NO: 828477

SEQ ID NO: 828480 - protein, 185 aa, Homo sapiens
LTRPWQKQEAVVLCQWWRRKLRFAPRTQAEAGRMAVMAMVIKDDRLNKDRCVRLALVHDMAECIVGDIAPADNIPKEEKHRREEEAMKQITQLLPEDLRKELYELWEEYETQSSAEAKFVKQLDQCEMILQASEYEDLEHKPGRLQDFYDSTAGKFNHPEIVQLVSELEAERSTNIAAAASEPHS

SEQ ID NO: 828481 - protein, 204 aa, Homo sapiens; identical to SEQ ID NO: 828477

SEQ ID NO: 828482 - protein, 204 aa, Homo sapiens; identical to SEQ ID NO: 828477

SEQ ID NO: 828483 - protein, 218 aa, Homo sapiens
MASVSSATFSGHGARSLLQFLRLVGQLKRVPRTGWVYRNVQRPESVSDHMYRMAVMAMVIKDDRLNKDRCVRLALVHDMAECIVGDIAPADNIPKEEKHRREEEAMKQITQLLPEDLRKELYELWEEYETQSSAEAKFVKQLDQCEMILQASEYEDLEHKPGRLQDFYDSTADVSLFVFNCLNFSKKCDTTWALKEATEQEAVMKVPWMNTGGGSACL

SEQ ID NO: 828484 - protein, 212 aa, Homo sapiens
SGSGGGGGGVGRGGGRGGAGRGAEGRRRGGGERDRRRVPRTGWVYRNVQRPESVSDHMYRMAVMAMVIKDDRLNKDRCVRLALVHDMAECIVGDIAPADNIPKEEKHRREEEAMKQITQLLPEDLRKELYELWEEYETQSSAEAKFVKQLDQCEMILQASEYEDLEHKPGRLQDFYDSTAGKFNHPEIVQLVSELEAERSTNIAAAASEPHS

SEQ ID NO: 828485 - protein, 131 aa, Homo sapiens
SGSGGGGGGVGRGGGRGGAGRGAEGRRRGGGERDRRVRGGGRKTRGRGGGGGRGGASPRPAPPSRGRWPHGFGLLCDLLGPRGSVPTAVPAAGRAAQESPTNWLGIQKCPEAGERFRSHVPDGSYGYGDQR

SEQ ID NO: 828486 - protein, 66 aa, Homo sapiens; identical to SEQ ID NO: 828476

SEQ ID NO: 828487 - protein, 212 aa, Homo sapiens; identical to SEQ ID NO: 828484

SEQ ID NO: 828488 - protein, 204 aa, Homo sapiens; identical to SEQ ID NO: 828477

SEQ ID NO: 828489 - protein, 131 aa, Homo sapiens; identical to SEQ ID NO: 828485

SEQ ID NO: 828490 - protein, 131 aa, Homo sapiens; identical to SEQ ID NO: 828485

SEQ ID NO: 828491 - protein, 629 aa, Homo sapiens
AAAAEGAGSEASVGSVRLRSIMSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKDRPWIWNIPYVKAPDTHGNMWVPS

SEQ ID NO: 828492 - protein, 298 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGTHL

SEQ ID NO: 828493 - protein, 608 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKDRPWIWNIPYVKAPDTHGNMWVPS

SEQ ID NO: 828494 - protein, 324 aa, Homo sapiens
AAAAEGAGSEASVGSVRLRSIMSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGHFVHLCLC

SEQ ID NO: 828495 - protein, 509 aa, Homo sapiens
MPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKDRPWIWNIPYVKAPDTHGNMWVPS

SEQ ID NO: 828496 - protein, 200 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKGKRMLGVKELLNCP

SEQ ID NO: 828497 - protein, 118 aa, Homo sapiens
RGGRRRGGIRGKRWFCAPQVRVGRQWARTRCGLSRAAVGPGILLLAESRCAGCWGPAGLEADREEAARPGRWGRVASAPGPRFPPITAPQGARTGAAETCVLPGRGARGPCSGFYSQT

SEQ ID NO: 828498 - protein, 124 aa, Homo sapiens
RGGRRRGGIRGKRWFCAPQVRVGRQWARTRCGLSRAAVGPGILLLAESRCAGCWGPAGLEADREEAARPGRWGRVASAPGPRFPPITAPQGARTGAAETCVLPGRGARGPCSGFYFPPPKGKTP

SEQ ID NO: 828499 - protein, 608 aa, Homo sapiens; identical to SEQ ID NO: 828493

SEQ ID NO: 828500 - protein, 608 aa, Homo sapiens; identical to SEQ ID NO: 828493

SEQ ID NO: 828501 - protein, 608 aa, Homo sapiens; identical to SEQ ID NO: 828493

SEQ ID NO: 828502 - protein, 590 aa, Homo sapiens
AAAAEGAGSEASVGSVRLRSIMSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFAPAKRIKDEVEASFSGNAWIS

SEQ ID NO: 828503 - protein, 200 aa, Homo sapiens; identical to SEQ ID NO: 828496

SEQ ID NO: 828504 - protein, 118 aa, Homo sapiens; identical to SEQ ID NO: 828497

SEQ ID NO: 828505 - protein, 246 aa, Homo sapiens
MGPQHLRLVQLFCLLGAISTLPRAGALLCYEATASRFRAVAFHNWKWLLMRNMVCKLQEGCEETLVFIETGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 828506 - protein, 211 aa, Homo sapiens
MGPQHLRLVQLFCLLGAISTLPRMSCGAGCYKTQKGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 828507 - protein, 117 aa, Homo sapiens
PVVLSGVVDPISRAAPQPLSLPVLGASGAAAYGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828508 - protein, 86 aa, Homo sapiens
YTAGSEAGWRALREPRLMVQTWPSPRTTPHTTSPENGTEMVSRNPDHKDTNLLRGWTPSFLRNMRFAKKHNKKGLKKMQANKCQGP

SEQ ID NO: 828509 - protein, 86 aa, Homo sapiens; identical to SEQ ID NO: 828508

SEQ ID NO: 828510 - protein, 86 aa, Homo sapiens; identical to SEQ ID NO: 828508

SEQ ID NO: 828511 - protein, 111 aa, Homo sapiens
DHASRTRGSTHASGPTRPGASGAAAYGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828512 - protein, 104 aa, Homo sapiens
RCHPRLTGGGGARAAERTGGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828513 - protein, 92 aa, Homo sapiens
RRLLLLLNSRPFDCPSTIPKGVSRKLDRLAYIAHPKLGKRARARIAKGLRLCRPKAKAKAKAKDQTKAQAAAPASVPAQAPKRTQAPTKASE

SEQ ID NO: 828514 - protein, 96 aa, Homo sapiens
NSARASGAAAYGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828515 - protein, 117 aa, Homo sapiens; identical to SEQ ID NO: 828507

SEQ ID NO: 828516 - protein, 66 aa, Homo sapiens
IRHALREPRLMVQTWPSPRTTPHTTSVSFLGPAYIPDPGKDWFRQTGTEMKGHVSIVGLRLIDFTQ

SEQ ID NO: 828517 - protein, 105 aa, Homo sapiens
KWQDEAGVNSDRGASGAAAYGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828518 - protein, 104 aa, Homo sapiens
SLNIRVLSSGSGASGAAAYGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828519 - protein, 110 aa, Homo sapiens
AYVAGLYRGRLFSLRVLGASGAAAYGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828520 - protein, 117 aa, Homo sapiens; identical to SEQ ID NO: 828507

SEQ ID NO: 828521 - protein, 117 aa, Homo sapiens; identical to SEQ ID NO: 828507

SEQ ID NO: 828522 - protein, 117 aa, Homo sapiens; identical to SEQ ID NO: 828507

SEQ ID NO: 828523 - protein, 117 aa, Homo sapiens; identical to SEQ ID NO: 828507

SEQ ID NO: 828524 - protein, 117 aa, Homo sapiens; identical to SEQ ID NO: 828507

SEQ ID NO: 828525 - protein, 117 aa, Homo sapiens; identical to SEQ ID NO: 828507

SEQ ID NO: 828526 - protein, 94 aa, Homo sapiens
FGTKAGEDIGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828527 - protein, 117 aa, Homo sapiens; identical to SEQ ID NO: 828507

SEQ ID NO: 828528 - protein, 72 aa, Homo sapiens
NSARASGAAAYGADMAKSKNHTTHNQSRKWHRNGIKKPRSQRYESLKGVDPKFPEEHALCQEAQHRGYQGPR

SEQ ID NO: 828529 - protein, 81 aa, Homo sapiens
IRHALREPRLMVQTWPSPRTTPHTTSPENGTEMVDPKFPEEHALCQEAQQKGPKEDAGQQMPRPMSARAEAIKALVKAQGG

SEQ ID NO: 828530 - protein, 72 aa, Homo sapiens
PVVLSGVVDPISRAAPQPLSLPVLGASGAAAYGADMAKSKNHTTHNQSRKWHRNGIKKPRSQRYESLKGPEV

SEQ ID NO: 828531 - protein, 117 aa, Homo sapiens; identical to SEQ ID NO: 828507

SEQ ID NO: 828532 - protein, 116 aa, Homo sapiens
RCHPRLTGGGGARAAERTGDRPCVCREQKLRGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828533 - protein, 111 aa, Homo sapiens; identical to SEQ ID NO: 828511

SEQ ID NO: 828534 - protein, 104 aa, Homo sapiens; identical to SEQ ID NO: 828512

SEQ ID NO: 828535 - protein, 111 aa, Homo sapiens
RNFPQRKIIRVETSTTGPGASGAAAYGADMAKSKNHTTHNQSRKWHRNGIKKPRSQRYESLKGVDPKFPEEHALCQEAQQKGPKEDAGQQMPRPMSARAEAIKALVKAQGG

SEQ ID NO: 828536 - protein, 141 aa, Homo sapiens
AKGLSLCRPKAKAKAKAKDQTKAQAAAPASVPAQAPPGIQHSTQSSAVRPLPRQQASRYERSEYPTQNMTQSRKWHRNGIKKPRSQRYESLKGVDPKFPEEHALCQEAQQKGPKEDAGQQMPRPMSARAEAIKALVKAQGG

SEQ ID NO: 828537 - protein, 86 aa, Homo sapiens; identical to SEQ ID NO: 828508

SEQ ID NO: 828538 - protein, 117 aa, Homo sapiens; identical to SEQ ID NO: 828507

SEQ ID NO: 828539 - protein, 121 aa, Homo sapiens
MRTEGLVRPPTPAPGLPSAWGWGPPVLFVQINLRQDLLASVYEPVDIPKGVSRKLDRLAYIAHPKLGKRARARIAKGLRLCRPKAKAKAKAKDQTKAQAAAPASVPAQAPKRTQAPTKASE

SEQ ID NO: 828540 - protein, 117 aa, Homo sapiens; identical to SEQ ID NO: 828507

SEQ ID NO: 828541 - protein, 117 aa, Homo sapiens; identical to SEQ ID NO: 828507

SEQ ID NO: 828542 - protein, 121 aa, Homo sapiens; identical to SEQ ID NO: 828539

SEQ ID NO: 828543 - protein, 117 aa, Homo sapiens; identical to SEQ ID NO: 828507

SEQ ID NO: 828544 - protein, 141 aa, Homo sapiens; identical to SEQ ID NO: 828536

SEQ ID NO: 828545 - protein, 121 aa, Homo sapiens; identical to SEQ ID NO: 828539

SEQ ID NO: 828546 - protein, 72 aa, Homo sapiens
EFGTRFGSRGLWCRHGQVQEPHHTQPVPKMAQKWYTNLLRGWTPSFLRNMRFAKKHNKKGLKKMQANKCQGP

SEQ ID NO: 828547 - protein, 397 aa, Homo sapiens
MSVGRRRIKLLGILMMANVFIYFIMEVSKSSSQEKNGKGEVIIPKEKFWKISTPPEAYWNREQEKLNRQYNPILSMLTNQTGEAGRLSNISHLNYCEPDLRVTSVVTGFNNLPDRFKDFLLYLRCRNYSLLIDQPDKCAKKPFLLLAIKSLTPHFARRQAIRESWGQESNAGNQTVVRVFLLGQTPPEDNHPDLSDMLKFESEKHQDILMWNYRDTFFNLSLKEVLFLRWVSTSCPDTEFVFKGDDDVFVNTHHILNYLNSLSKTKAKDLFIGDVIHNAGPHRDKKLKYYIPEVVYSGLYPPYAGGGGFLYSGHLALRLYHITDQVHLYPIDDVYTGMCLQKLGLVPEKHKGFRTFDIEEKNKNNICSYVDLMLVHSRKPQEMIDIWSQLQSAHLKC

SEQ ID NO: 828548 - protein, 397 aa, Homo sapiens; identical to SEQ ID NO: 828547

SEQ ID NO: 828549 - protein, 397 aa, Homo sapiens; identical to SEQ ID NO: 828547

SEQ ID NO: 828550 - protein, 397 aa, Homo sapiens; identical to SEQ ID NO: 828547

SEQ ID NO: 828551 - protein, 393 aa, Homo sapiens
MVSRSLLGILMMANVFIYFIMEVSKSSSQEKNGKGEVIIPKEKFWKISTPPEAYWNREQEKLNRQYNPILSMLTNQTGEAGRLSNISHLNYCEPDLRVTSVVTGFNNLPDRFKDFLLYLRCRNYSLLIDQPDKCAKKPFLLLAIKSLTPHFARRQAIRESWGQESNAGNQTVVRVFLLGQTPPEDNHPDLSDMLKFESEKHQDILMWNYRDTFFNLSLKEVLFLRWVSTSCPDTEFVFKGDDDVFVNTHHILNYLNSLSKTKAKDLFIGDVIHNAGPHRDKKLKYYIPEVVYSGLYPPYAGGGGFLYSGHLALRLYHITDQVHLYPIDDVYTGMCLQKLGLVPEKHKGFRTFDIEEKNKNNICSYVDLMLVHSRKPQEMIDIWSQLQSAHLKC

SEQ ID NO: 828552 - protein, 397 aa, Homo sapiens; identical to SEQ ID NO: 828547

SEQ ID NO: 828553 - protein, 120 aa, Homo sapiens
MVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGGKSLKSFY

SEQ ID NO: 828554 - protein, 568 aa, Homo sapiens
MKALGNRKARSFWLPGLVTLVLGDLSPKGQLLKGVIQRHGASGYGFVLGLFLTPASTHVLDWITDSCPRIKMTDLMTASAFFVSRVIYLEGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828555 - protein, 580 aa, Homo sapiens
MIKASVLQHFPNEGIRKKKSTVFLAPWSSHIGTEGDLSPKGQLLKGVIQRHGASGYGFVLGLFLTPASTHVLDWITDSCPRIKMTDLMTASAFFVSRVIYLEGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828556 - protein, 541 aa, Homo sapiens
MGQLLKGVIQRHGASGYGFVLGLFLTPASTHVLDWITDSCPRIKMTDLMTASAFFVSRVIYLEGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828557 - protein, 538 aa, Homo sapiens
MLKGVIQRHGASGYGFVLGLFLTPASTHVLDWITDSCPRIKMTDLMTASAFFVSRVIYLRGRDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828558 - protein, 538 aa, Homo sapiens
MLKGVIQRHGASGYGFVLGLFLTPASTHVLDWITDSCPRIKMTDLMTASAFFVSRVIYLKGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMILFHFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828559 - protein, 492 aa, Homo sapiens
MTASAFFVSRVIYLEGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFSCLKKQKFGVMITKGPFPKDGKPRIQWRLGQILKVLSIAGENRRMSLRVFLFFFLERGKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFEFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828560 - protein, 479 aa, Homo sapiens
MGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828561 - protein, 525 aa, Homo sapiens
MGLFWVCFELLPPHMFLTDELTHVPELKWLTYDSISILCKQSDISEEGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFSCLKKQKFGVMITKGPFPKDGKPRIQWRLGQILKVLSIAGENRRMSLRVFLFFFPEKEVRIMGKVEKAAPTDLLREAESVSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMFFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828562 - protein, 568 aa, Homo sapiens; identical to SEQ ID NO: 828554

SEQ ID NO: 828563 - protein, 392 aa, Homo sapiens
MYINILVRGAGNGMRAFTVLGNGGREDFAFAFALRENFELTKKTEVWGHDHKGAIPKRWQATYSVETRPNSKWFVSIAGENRRMSLRVFLFFFLERGKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828564 - protein, 343 aa, Homo sapiens
MITKGPFPKDGKPRIQWRLGQILKVLSIAGENRRMSLRVFSSFFLERGKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828565 - protein, 188 aa, Homo sapiens
MNFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828566 - protein, 473 aa, Homo sapiens
ATVGAEAQGEVACRGSPGSRRRGGRGRMAEGAQPQQPPQLGPGAAARGMKRESELELPVPGAGGDGADPGLSKRPRTEEAAADGGGGMQNEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 828567 - protein, 473 aa, Homo sapiens; identical to SEQ ID NO: 828566

SEQ ID NO: 828568 - protein, 221 aa, Homo sapiens
EYQQAYRFYLVHGTGLVNILGVPYNQKRGGRGRMAEGAQPQQPPQLGPGAAARGMKRESELELPVPGAGGDGADPGLSKRPRTEEAAADGGGGMQNEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHCDSL

SEQ ID NO: 828569 - protein, 103 aa, Homo sapiens
MEKKKMVTQGNQEPTTTPDAMVQPFTTIPFPPPPQNGIPTDVTVSNSLPFSLRIILYSSFQTIQYSLGYSYYYQVAGIVKVGVVRSLAFIPYFFVLLSMCINY

SEQ ID NO: 828570 - protein, 568 aa, Homo sapiens; identical to SEQ ID NO: 828554

SEQ ID NO: 828571 - protein, 577 aa, Homo sapiens
MSYSISQMKALGNKKSTVFLAPWSSHIGTRVTFSPKGQLLKGVIQRHGASGYGFVLGLFLTPASTHVLDWITDSCPRIKMTDLMTASAFFVSRVIYLRGRDLLCRIHILSPFRILSRLVTGREAVPETRGDVKEARGLDAIITDSGEEDREYGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPEKEVRIMGKVEKAAPTDLLREAESVSLRHLECISVQLVLAEASKGKLCAFQWFLLHFQGWCLTPLPPAPFSKKEVNGVLLFMKGSLVFSVNTENWGSCKHLDFTVSTSPSPFELETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828572 - protein, 568 aa, Homo sapiens
MKALGNRKARSFWLPGLVTLVLGDLSPKGQLLKGVIQRHGASGYGFVLGLFLTPASTHVLDWITDSCPRIKMTDLMTASAFFVSRVIYLRGRDLLCRIHILSPFRILSRLVTGREAVPETRGDVKEARGLDAIITDSGEEDREYGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKELNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828573 - protein, 515 aa, Homo sapiens
MPPHMFLTDELTHVPELKWLTYDSISILCKQSDISEEGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828574 - protein, 463 aa, Homo sapiens
ATVGAEAQGEVACRGSPGSRRRGGRGRMAEGAQPQQPPQLGPGAAARGMKRESELELPVPGAGGDGADPGLSKRPRTEEAAADGGGGMQNEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVDMQPTDMHSLLLQPQPPLLQPLQPLTVTVMAGCTQPTPTMPLPLPLAMELALWRVYTEVATADLPPTEVT

SEQ ID NO: 828575 - protein, 503 aa, Homo sapiens
MSLNENDLTYDSISILCKQSDISEEGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828576 - protein, 489 aa, Homo sapiens
MLCKQSDISEEGVDLLCRIHILSPFRILSRLVTGREAVPETRGDVKEARGLDAIITDSGEEDREEGDTNCPVHWPFLRVPPPQAKVWFVAVEDNFCCMYINILVRGAGNGMRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828577 - protein, 379 aa, Homo sapiens
MRAFTVLGNGGREDFAFAFALRENFELTKKTEVWGHDHKGAIPKRWQATYSVETRPNSKWFVSIAGENRRMSLRVFLFFFPRKSKDNGKGREGGSHRPFKRGRILSLRHLECISVQLVLAEASKGKLCAFQWFLLHFQGWCLTPLPPAPFSKKEVNGVLLFMKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828578 - protein, 568 aa, Homo sapiens; identical to SEQ ID NO: 828554

SEQ ID NO: 828579 - protein, 218 aa, Homo sapiens
MKGSLVFSVNTENWGSCKHLDFTVSTSPSPFDFETPYGQLHQRQVARSSTACLFLTLVLTVLKKESQRSLAFREFVRGCWLIIPENLLMLNHSTCMIFFSFTIVHDLDFLYSWKLGSLKEASSDTFISMSLLEPRELPIGIFQNSSCHLVQFPLTQISHCDSPFVRLSGLTKPTITIILQQPQSELSQHFFFFEKEVDWGTTFSLRGASGNLDNRSHR

SEQ ID NO: 828580 - protein, 473 aa, Homo sapiens; identical to SEQ ID NO: 828566

SEQ ID NO: 828581 - protein, 463 aa, Homo sapiens; identical to SEQ ID NO: 828574

SEQ ID NO: 828582 - protein, 118 aa, Homo sapiens
EYQQAYRFYLVHGTGLVNILGVPYNQKRGGRGRMAEGAQPQQPPQLGPGAAARGMKRESELELPVPGAGGDGADPGLSKRPRTEEAAADGGGGMQNEPLTPGYHGFPARDSQVGICCL

SEQ ID NO: 828583 - protein, 863 aa, Homo sapiens
GSAGLEPALGGCPLGASQLPSAPAMDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKRLWWLKLTALADLEDWEELEKFSKSKKSPIGYLPFVEICMKQHNKYEAKKYASRVGPEQKVKALLLVGDVAQAADVAIEHRNEAELSLVLSHCTGATDGATADKIQRARAQAQKK

SEQ ID NO: 828584 - protein, 781 aa, Homo sapiens
GSAGLEPALGGCPLGASQLPSAPAMDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRVGLDGRAGEGGAGRGWDGQQGSSLLSPSGSSQAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKR

SEQ ID NO: 828585 - protein, 749 aa, Homo sapiens
GSAGLEPALGGCPLGASQLPSAPAMDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKR

SEQ ID NO: 828586 - protein, 805 aa, Homo sapiens
GSAGLEPALGGCPLGASQLPSAPAMDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKESQKADEYLREIQELGQLTQAVQQCIEAAGHEHQPDMQKSLLRVGLDGRAGEGGAGRGWDGQQGSSLLSPSGSSQAASFGKCFLDRFPPDSFVHMCQDLRVLNAVRDYHIGIPLTYSQYPCARQKGTLQPGVAGEGAGDALQVPGKRGLFSNWILNRGKYRYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKR

SEQ ID NO: 828587 - protein, 809 aa, Homo sapiens
TAAAAELPPADSAGIAGMLQQGAWGQPHQGLRQCRAVGEQAFHAIHRLQVPALQGARDLGSIIRRKAWYKVRKELACEQCCGVRSQRGLQGLQLLQGLPHTPWWAARPWKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRVGLDGRAGEGGAGRGWDGQQGSSLLSPSGSSQAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKR

SEQ ID NO: 828588 - protein, 793 aa, Homo sapiens [sequence omitted]

SEQ ID NO: 828589 - protein, 781 aa, Homo sapiens; identical to SEQ ID NO: 828584

SEQ ID NO: 828590 - protein, 781 aa, Homo sapiens; identical to SEQ ID NO: 828584

SEQ ID NO: 828591 - protein, 781 aa, Homo sapiens; identical to SEQ ID NO: 828584

SEQ ID NO: 828592 - protein, 781 aa, Homo sapiens; identical to SEQ ID NO: 828584

SEQ ID NO: 828593 - protein, 781 aa, Homo sapiens; identical to SEQ ID NO: 828584

SEQ ID NO: 828594 - protein, 895 aa, Homo sapiens
GSAGLEPALGGCPLGASQLPSAPAMDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRVGLDGRAGEGGAGRGWDGQQGSSLLSPSGSSQAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKRLWWLKLTALADLEDWEELEKFSKSKKSPIGYLPFVEICMKQHNKYEAKKYASRVGPEQKVKALLLVGDVAQAADVAIEHRNEAELSLVLSHCTGATDGATADKIQRARAQAQKK

SEQ ID NO: 828595 - protein, 854 aa, Homo sapiens
GSAGLEPALGGCPLGASQLPSAPAMDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRVGLDGRAGEGGAGRGWDGQQGSSLLSPSGSSQAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKRLWWLKLTALADLEDWEELEKFSKSKKSPIGYLPFVEICMKQHNKYEAKKYASRVGPEQKRCGSGCRCGHRTPE

SEQ ID NO: 828596 - protein, 781 aa, Homo sapiens; identical to SEQ ID NO: 828584

SEQ ID NO: 828597 - protein, 646 aa, Homo sapiens
GSAGLEPALGGCPLGASQLPSAPAMDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRVGLDGRAGEGGAGRGWDGQQGSSLLSPSGSSQAASFGKCFLDRFPPDSFVHMCQDLRVLNAVRDYHIGIPLTYSQYPCARQKGPYSQGWQGKGLEMRLQVPGKRGLFSNWILNRGKYRYKQLTIQVLLDRLVLRRLYPLAIQICEYLRLPEVQGVSRILAHWACYKVQQKDVSDEDVARAINQKLGDTPGVSYSDIAARAYGCGRTELAIKVWVPSPPQTL

SEQ ID NO: 828598 - protein, 72 aa, Homo sapiens
CGLVRGRVCALEQPQHHLLSCSNHSDVAQAADVAIEHRNEAELSLVLSHCTGATDGATADKIQRARAQAQKK

SEQ ID NO: 828599 - protein, 101 aa, Homo sapiens
SVRGRCARVGSGRGSGSRGRWEGSRATAQSPEPEALSHLFRVEACGRLQVDCASLRVRRGEGVPGNVPARVPTPRDCPGTLHASFWDQARALPELILREET

SEQ ID NO: 828600 - protein, 781 aa, Homo sapiens
GSAGLEPALGGCPLGASQLPSAPAMDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKVLGAQPSTDTLMWLFRAPMPAPSLCAFLLTSQLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKR

SEQ ID NO: 828601 - protein, 802 aa, Homo sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 828602 - protein, 802 aa, Homo sapiens; identical to SEQ ID NO: 828601

SEQ ID NO: 828603 - protein, 781 aa, Homo sapiens; identical to SEQ ID NO: 828584

SEQ ID NO: 828604 - protein, 781 aa, Homo sapiens; identical to SEQ ID NO: 828584

SEQ ID NO: 828605 - protein, 762 aa, Homo sapiens
VRFGIRERLSGSHVRLGEIVMPIEWGSLSVAPTFSPNITLGPTYLTTVNSSDSDNGTTRTASTNSIGITISPNGTWLPDNQFTDARTEPWEGNSSTAATTPETFPPSDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 828606 - protein, 895 aa, Homo sapiens; identical to SEQ ID NO: 828594

SEQ ID NO: 828607 - protein, 895 aa, Homo sapiens; identical to SEQ ID NO: 828594

SEQ ID NO: 828608 - protein, 781 aa, Homo sapiens; identical to SEQ ID NO: 828584

SEQ ID NO: 828609 - protein, 314 aa, Homo sapiens
TAAAAELPPADSAGIAGMLQQGAWGQPHQGLRQCRAVGEQAFHAIHRLQVPALQGARDLGSIIRRKAWYKVRKELACEQCCGVRSQRGLQGLQLLQGLPHTPWWAARPWKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVPLSVIAKAVNEKSCSSPTELTQGLSCTVVLASYKAQEEGRGQKTPWPKTLLL

SEQ ID NO: 828610 - protein, 108 aa, Homo sapiens
ACGYRGHTWSRHWYAAHIFVPATTPPAALLSGRRLFRGAHPVVRRLSKHRPALALPRCPKYTGNIGRQDGSNGSIAPVARGWARLEGVSGCPTGLICTSLWVLGKEDP

SEQ ID NO: 828611 - protein, 146 aa, Homo sapiens
PTASQLRPKGLRVGVFLHRGRVTACTHHTPKALHPATLRPHFIWAGPSWVAVSFIAPLSQILKSLSLKIKSRPGAVAHTCNPTLWEAKAGGSLEPRIRDQPGQHDKILSLQKITKIIWAWRHTPVVPATWEAEVEGSPEPMRWRLQ

SEQ ID NO: 828612 - protein, 793 aa, Homo sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 828613 - protein, 1237 aa, Homo sapiens
IRGSGYHGTERQRHLLLFVFWWQKGKMANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828614 - protein, 1084 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828615 - protein, 1191 aa, Homo sapiens
IRGSGYHGTERQRHLLLFVFWWQKGKMANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHVRKNPHSMIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828616 - protein, 1138 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828617 - protein, 1161 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVQWSHLASLKNNVSPVSRSHSFSDPSPKFAHHHLRSQDPCPPSRSEVLSQSSDSKSEAPDPTQKAWSRSDSDEVPPRVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828618 - protein, 981 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828619 - protein, 1237 aa, Homo sapiens; identical to SEQ ID NO: 828613

SEQ ID NO: 828620 - protein, 1340 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASGLCRISFTYFRLEGDLSIKNMWLRGLQSFLRGPLTELRNYKEGPKPQTYLFPSIGIVCFPCIKSQVSKTFFLLFQPYTWCTVSLTKLCRTKYSSYLMKFPSKETDALKKIQKKEKPFYLFLGINLYLFFVSSAFTILAFRLSFLVIVVTASHPSLLIPLMLPDHVIVHALWNFKPVRVFISCLNDFCTSPSPLLSPALPCTVHSSSTMASRTPRNCAVLKGEVDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQSTVDQKRASHHESNGFAGRIHLLPDLLQQSHSSSTSSTSSSPSSSQPTPTMSPQTPQDKLTANETQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828621 - protein, 489 aa, Homo sapiens [sequence omitted]

SEQ ID NO: 828622 - protein, 1237 aa, Homo sapiens; identical to SEQ ID NO: 828613

SEQ ID NO: 828623 - protein, 1237 aa, Homo sapiens; identical to SEQ ID NO: 828613

SEQ ID NO: 828624 - protein, 137 aa, Homo sapiens
MIPKCYRPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828625 - protein, 567 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASGLCRISFTYFRLE

SEQ ID NO: 828626 - protein, 567 aa, Homo sapiens; identical to SEQ ID NO: 828625

SEQ ID NO: 828627 - protein, 421 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRVLLLLLRYEKCITQAITAFIWSNAPFYILLRISRTESLYTTFPRLLCQLASTVRFSKAGDWLASGRITPLFSCYCSVLGSSSSRSSEQLWKNAGNYT

SEQ ID NO: 828628 - protein, 291 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQPWTSSQPWTSSQPWTSSPRGLV

SEQ ID NO: 828629 - protein, 239 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSRGGGFLGMRNSALIGCMSQ

SEQ ID NO: 828630 - protein, 137 aa, Homo sapiens
RIPWMLSPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828631 - protein, 1215 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVQWSHLASLKNNVSPVSRSHSFSDPSPKFAHHHLRSQDPCPPSRSEVLSQSSDSKSEAPDPTQKAWSRSDSDEVPPRVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828632 - protein, 932 aa, Homo sapiens
GCFIAFASTYWSGLPRTYCRLASTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828633 - protein, 1237 aa, Homo sapiens; identical to SEQ ID NO: 828613

SEQ ID NO: 828634 - protein, 1117 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAASDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQSTVDQKRASHHESNGFAGRIHLLPDLLQQSHSSSTSSTSSSPSSSQPTPTMSPQTPQDKLTANETQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828635 - protein, 1237 aa, Homo sapiens; identical to SEQ ID NO: 828613

SEQ ID NO: 828636 - protein, 585 aa, Homo sapiens
FNFYTVKPYLYKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQSTVDQKRASHHESNGFAGRIHLLPDLLQQSHSSSTSSTSSSPSSSQPTPTMSPQTPQDKLTANETQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 828637 - protein, 137 aa, Homo sapiens; identical to SEQ ID NO: 828630

SEQ ID NO: 828638 - protein, 567 aa, Homo sapiens; identical to SEQ ID NO: 828625

SEQ ID NO: 828639 - protein, 341 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQLKAKEESEESDEDMGFGL

SEQ ID NO: 828640 - protein, 292 aa, Homo sapiens
MEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSAIMNVPVESTIPRRSQWSMAAGGLRTCPRDSEQCTTFMSDRARISGIISSCVLSE

SEQ ID NO: 828641 - protein, 197 aa, Homo sapiens
IRGSGYHGTERQRHLLLFVFWWQKGKMANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLGM

SEQ ID NO: 828642 - protein, 1327 aa, Homo sapiens
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 828643 - protein, 1327 aa, Homo sapiens; identical to SEQ ID NO: 828642

SEQ ID NO: 828644 - protein, 705 aa, Homo sapiens
MGQYSPLSTHLRLSSFPTQAAPIMHAAPQVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 828645 - protein, 1063 aa, Homo sapiens
GRVAPPGREQHWPILQMGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLARGPAQRLLPLGEGAHGEHHCPCARRGRGQGLLAHRSTKGIRGGGGPRGPGGRHVHWLFHRSVVRGGAQRQPHEAAGPGVGQEHDFGAGTCVGPHVPSHLHVHWVCL

SEQ ID NO: 828646 - protein, 1390 aa, Homo sapiens
GRVAPPGREQHWPILQMGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPVCHTWNIRAEMCVDKDYRSVDIRCESSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 828647 - protein, 1044 aa, Homo sapiens
GRVAPPGREQHWPILQMGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLVLAFPSSGFTDLAEIVSRIEPPTSYVSDGCADGEESDCLTEYEEDAGPDCSRDEGGSPEGASPSTASEMDGGRSRSSPGQQNAWWGPK

SEQ ID NO: 828648 - protein, 1382 aa, Homo sapiens
GRVAPPGREQHWPILQMGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 828649 - protein, 1408 aa, Homo sapiens
GRVAPPGREQHWPILQMGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEVGSRGELGTGRKGGLAAPISTPLPPQDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 828650 - protein, 1345 aa, Homo sapiens
GRVAPPGREQHWPILQMGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 828651 - protein, 227 aa, Homo sapiens [sequence omitted]

SEQ ID NO: 828652 - protein, 150 aa, Homo sapiens
MAARGVIAPVGESLRYAEYLQPSAKRPDADVDQQRLVRSLIAVGLGVAALAFAGRYAFRIWKPLEQVITETAKKISTPSFSSYYKGGFEQKMSRREAGLILGVSPSAGKAKIRTAHRRVMILNHPDKGGSPYVAAKINEAKDLLETTTKH

SEQ ID NO: 828653 - protein, 138 aa, Homo sapiens
PTRRPRVRTHASERPDADVDQQRLVRSLIAVGLGVAALAFAGRYAFRIWKPLEQVITETAKKISTPSFSSYYKGGFEQKMSRREAGLILGVSPSAGKAKIRTAHRRVMILNHPDKGGSPYVAAKINEAKDLLETTTKH

SEQ ID NO: 828654 - protein, 150 aa, Homo sapiens; identical to SEQ ID NO: 828652

SEQ ID NO: 828655 - protein, 150 aa, Homo sapiens; identical to SEQ ID NO: 828652

SEQ ID NO: 828656 - protein, 150 aa, Homo sapiens; identical to SEQ ID NO: 828652

SEQ ID NO: 828657 - protein, 150 aa, Homo sapiens; identical to SEQ ID NO: 828652

SEQ ID NO: 828658 - protein, 104 aa, Homo sapiens
MAARGVIAPVGESLRYAEYLQPSAKRPDADVDQQRLVRSLIAVGLGVAALAFAGRYAFRIWKPLEQVITETAKKISTPSFSSYYKGGFEQKMSRREAGLILGVR

SEQ ID NO: 828659 - protein, 577 aa, Homo sapiens
MTELAGASSSCCHRPAGRGAMQSVLHHFQRLRGREGGSHFINTSSPRGEAKMSITSDEVNFLVYRYLQESGFSHSAFTFGIESHISQSNINGTLVPPAALISILQKGLQYVEAEISINEDGTVFDGRPIESLSLIDAVMPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 828660 - protein, 78 aa, Homo sapiens
DGAWGPRPPSPGFYLTIPTWFTFIKTKAIPRERPWLPTFISIPVLSGTTPWTAVFRASSICTPLLTLSAAGMLVESSL

SEQ ID NO: 828661 - protein, 526 aa, Homo sapiens
MSITSDEVNFLVYRYLQESGFSHSAFTFGIESHISQSNINGTLVPPAALISILQKGLQYVEAEISINEDGTVFDGRPIESLSLIDAVMPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 828662 - protein, 439 aa, Homo sapiens
MPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 828663 - protein, 526 aa, Homo sapiens; identical to SEQ ID NO: 828661

SEQ ID NO: 828664 - protein, 526 aa, Homo sapiens; identical to SEQ ID NO: 828661

SEQ ID NO: 828665 - protein, 429 aa, Homo sapiens [sequence omitted]

SEQ ID NO: 828666 - protein, 140 aa, Homo sapiens
MTELAGASSSCCHRPAGRGAMQSVLHHFQRLRGREGGSHFINTSSPRGEAKMSITSDEVNFLVYRYLQESGKRLGFLSVGNSSTASYKQKDQRLIQNQAVEEEEEELRRFLVLMGRREGSGAVPSPGGKRECVLSSLDTS

SEQ ID NO: 828667 - protein, 526 aa, Homo sapiens; identical to SEQ ID NO: 828661

SEQ ID NO: 828668 - protein, 526 aa, Homo sapiens; identical to SEQ ID NO: 828661

SEQ ID NO: 828669 - protein, 110 aa, Homo sapiens
PGSPGATKGRLKGRPHHVLLGGLEWQLIHNKTQSILLIHNYGDCISVRVEENHTISDASQSTRPTVKGWSLQTASHFYDRMLGSLLVHRSIHEVTIRGWFPLHQHLIAAR

SEQ ID NO: 828670 - protein, 233 aa, Homo sapiens
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLDCSQGYTEENTIFAPRIQFFAIEIARNREGYNKAVYISVQDKEGEKGVNNGGEKRADSGEEENTKNGGEKGADSGEEKEEGINREDKTDKGGEKGKEADKEINKSGEKAM

SEQ ID NO: 828671 - protein, 210 aa, Homo sapiens
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLDCSQGYTEENTIFAPRIQFFAIEIARNREGYNKAVYISVQDKEGEKGVNNGGEKRADSGEEENTKNGGEKGADSGEEKEEGINREDK

SEQ ID NO: 828672 - protein, 232 aa, Homo sapiens
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEPPGYNSLPLKLLGTGKAITKLFISVFRTKKERKESTMEEKKELTVEKKRTPRMEERKELIVEKKKRKESTEKTKLTKEEKKGKKLTKKSTKVVKKLCKVYREQHSRSYDSIETTSTTVLLAQTPLVKCKFLYN

SEQ ID NO: 828673 - protein, 140 aa, Homo sapiens
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLDCSQGYTEENTIFAGRL

SEQ ID NO: 828674 - protein, 189 aa, Homo sapiens
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLDCSQGYTEENTIFAPRIQFFAIEIARNREGYNKAVYISVQDKEGEKGVNNRARLHLKKKNEEEEKK

SEQ ID NO: 828675 - protein, 124 aa, Homo sapiens
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLD

SEQ ID NO: 828676 - protein, 233 aa, Homo sapiens; identical to SEQ ID NO: 828670

SEQ ID NO: 828677 - protein, 233 aa, Homo sapiens; identical to SEQ ID NO: 828670

SEQ ID NO: 828678 - protein, 106 aa, Homo sapiens [sequence omitted]

SEQ ID NO: 828679 - protein, 232 aa, Homo sapiens; identical to SEQ ID NO: 828672

SEQ ID NO: 828680 - protein, 66 aa, Homo sapiens
GLATTAVADAWAQLETLQPRVLRTRSCSSFWTFRHPQACSSVPAFTVCERSPGLGPSPSRVAGGQG

SEQ ID NO: 828681 - protein, 759 aa, Homo sapiens
MCDLPQYVEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFPPSKAPSGLPGFGPKFTSSLLSPFFQEGFLDWSLLSLHGPFGIWASTWQTCPWPRSNLLVLVWGWRFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 828682 - protein, 706 aa, Homo sapiens
RGSDPKTQLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFPPSKAPSGLPGFGPKFTSSLLSPFFQEGFLDWSLLSLHGPFGIWASTWQTCPWPRSNLLVLVWGWRFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 828683 - protein, 479 aa, Homo sapiens
LVRGWVLIGRGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 828684 - protein, 901 aa, Homo sapiens
MAEPSQAPTPAPAAQPRPLQSPAPAPTPTPAPSPASAPIPTPTPAPAPAPAAAPAGSTGTGGPGVGSGGAGSGGDPARPGLSQQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFHPSKAPSGLPGFGPKFTSSLLSPFFQEGFLDWSLLSLHGPFGIWASTWQTCPWPRSNLLVLVWGWRFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 828685 - protein, 90 aa, Homo sapiens
GNGFNEMAFLLASTRMRQVKGYGTHLMNHLKEYHIKHNILYFLTYADEYAIGYFKKQGFSKDIKVPKSRYLGYIKDYEGATLMEYHQEAD

SEQ ID NO: 828686 - protein, 183 aa, Homo sapiens
SLPIHWKSDLSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 828687 - protein, 901 aa, Homo sapiens; identical to SEQ ID NO: 828684

SEQ ID NO: 828688 - protein, 901 aa, Homo sapiens; identical to SEQ ID NO: 828684

SEQ ID NO: 828689 - protein, 778 aa, Homo sapiens
MAEPSQAPTPAPAAQPRPLQSPAPAPTPTPAPSPASAPIPTPTPAPAPAPAAAPAGSTGTGGPGVGSGGAGSGGDPARPGLSQQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFHPSKAPSGLPGFGPKFTSSLLSPFFQEGFLDWSLLSLHGPFGIWASTWQTCPWPRSNLLVLVWGWRFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPCVPQRAPPPGQHTQFPSSSASSLLKIGDPLLPTSEVHPLSILYFSLPNPDYSSDFQGSGDLKGTVRGYDMPPSLFRKHKTLALIKDGRVIGGICFRMFPTQGFTEIVFCAVTSNEQVKGYGTHLMNHLKEYHIKHNILYFLTYADEYAIGYFKKQVTRSLVPHRSFAW

SEQ ID NO: 828690 - protein, 257 aa, Homo sapiens
MAEPSQAPTPAPAAQPRPLQSPAPAPTPTPAPSPASAPIPTPTPAPAPAPAAAPAGSTGTGGPGVGSGGAGSGGDPARPGLSQQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRAYILITIF

SEQ ID NO: 828691 - protein, 836 aa, Homo sapiens
MAEPSQAPTPAPAAQPRPLQSPAPAPTPTPAPSPASAPIPTPTPAPAPAPAAAPAGSTGTGGPGVGSGGAGSGGDPARPGLSQQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFPFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 828692 - protein, 901 aa, Homo sapiens; identical to SEQ ID NO: 828684

SEQ ID NO: 828693 - protein, 977 aa, Homo sapiens
MAEPSQAPTPAPAAQPRPLQSPAPAPTPTPAPSPASAPIPTPTPAPAPAPAAAPAGSTGTGGPGVGSGGAGSGGDPARPGLSQQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFHPSKAPSGLPGFGPKFTSSLLSPFFQEGFLDWSLLSLHGPFGIWASTWQTCPWPRSNLLVLVWGWRFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPCVPQRAPPPGQHTQFPSSSASSLLKIGDPLLPTSEVHPLSILYFSLPNPDYSSDFQGSGDLKGTVRGYDMPPSLFRKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 828694 - protein, 883 aa, Homo sapiens
MAEPSQAPTPAPAAQPRPLQSPAPAPTPTPAPSPASAPIPTPTPAPAPAPAAAPAGSTGTGGPGVGSGGAGSGGDPARPGLSQQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFHPSKAPSGLPGFGPKFTSSLLSPFFQEGFLDWSLLSLHGPFGIWASTWQTCPWPRSNLLVLVWGWRFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLTVKKSEAPDYYEVIRFPIDLKTMTERLRSRYYVTRKLFVADLQRVIANCREYNPPDSEYCRCASALEKFFYFKLKEGGLIDK

SEQ ID NO: 828695 - protein, 901 aa, Homo sapiens; identical to SEQ ID NO: 828684

SEQ ID NO: 828696 - protein, 901 aa, Homo sapiens; identical to SEQ ID NO: 828684

SEQ ID NO: 828697 - protein, 901 aa, Homo sapiens; identical to SEQ ID NO: 828684

SEQ ID NO: 828698 - protein, 128 aa, Homo sapiens
PGTSLVSPGLQCNEIITAPYSLDIPGVKGSSCRSLPILLGLQACITTPSLVVLLYIHVVLDTADASECFRRMQRGSRVNPCPLFVADLQRVIANCREYNPPDSEYCRCASALEKFFYFKLKEGGLIDK

SEQ ID NO: 828699 - protein, 111 aa, Homo sapiens
GAELFYREHPRERGEGEPCPWPGSIFLCLRRPCGLLTPHSWFYPPPTPSQGVLNFVQYKFSHLAPRERQTMFELSKMFLLCLNYWKLETPAQFRQRSQAEDVATYKVNYTR

SEQ ID NO: 828700 - protein, 111 aa, Homo sapiens
TLSPEREPDADPSGSDVRCPPEVSLVCCATGLEGELGPAPGEIRLCRSKSNLRSESCGGDVRALPGAWRLRVWGGGYSGEGIREAREWRAISLPPKKHLGSRYLGGGPTGK

SEQ ID NO: 828701 - protein, 1298 aa, Homo sapiens
MLGSTFKNVSSYFCRPLCPLLNVSIYYVQTSGEGFFKKFCSLVIYLFKKFILFFLRWSLALLPRLECSGAISANCNFHFPGSSDSPALASQVAGTTGACQHAWLIFVFLVERGFCHVGQAGLELLTSGDPPALASQSAGITGMSHCAQPCNFTFDGDLKCSMILYVARSNVSVFAELILGSTKKSLFPSHILYHISHLPQNLQLFGPGNDICCHFDDLKMVVGVEHSHEFRIPEHVDSHPSGKTRSLKRSLSKRKQFMLKKFLEKSLRIFDLSLDLMKLVVMMCIVCITVYEDGESSQHVWFILGIFREHFCCWHQVMNMVKKKTRFCLNIGKKSKLKGVIKTDKSSSYLCDDEAGSYTRKGWERLPGGTRGRSKHREPNRGLQCGTAARYVLGKMIGVLGDQAKRAGLGAVKYIFFFFLNKIMHWVNMYNAKLKICLSQVTLVNLSTTSFRTNLKNTLILSLNGHTLLTLLGACLSEAPRGRPSSIEGWGSPAPLQRPYSQTAAGSGRARAGRTAGSGAPLLRVVGGRSPILGPGPVEPLTGGRETAHPLEPTVRACRRRVTSLLQNWRSHRLKGRWQRLRERELAAGNQCSLPSELGVCSRFLGKCSAAATRFNGCCSLALNIEAKLPGVKINSMSIKDICPIPYSAVELMTGKHCAEVFGSSMAFFFFFFLTANGINLRYNSVSSSPVVFFQHVLLLPLTASVEPFLAMSAAIFNSQNNVMRVRKCTMKKQVSRREAPNSVQLARSSALKTRCDSEARFFFSLASLSILLSVPPQSLGLGRDKEYMDCSSTCCKHIHLSRAQVVRGVERTELEDSGCQSLLSLLLAVLEQWFLQVSRDRHILRSYPRPTESEIGGGAQQACSNLRAGRLQGSFRIYKRCFNSCCQSQKFHAEKPNLNDKGARLTLKITFFQIAIACQCSHSLCFYSFIFHYFKRRNCYEVYVQVRKFPGLRLFKTYNRPGTVAQACNPSTLGGRGGWITRSGVQDHPGQHGDTLSLLRIQNEPGMVAHACSPSYLRRLRQENSWNPGGRGCSELRLCHCTPAWVTEQDLVSKTKNKKTKLGIARAAHYLTFHGNFNSGILFQVVNIKSMCQCWWLSTLAAHNHFDAEATPSRVIQNPWRVGPDECFNVSRVIPMVAKVKNQYRTYKKVEKLISRTENLPLFQSTLKRHNWPLLLFPTSMNGQEKHHRESRVSAGTCIFVDDDLGYMFFHRLCFIGFVFSEALPHYIVLRIECGCLHGNEEVQQRLLVVVIIQAEKLHRQTYQFLPLQDITIEVGAKVIAVFAIKSNGTLLLHQPT

SEQ ID NO: 828702 - protein, 1244 aa, Homo sapiens
MRWSLALLPRLECSGAISANCNFHFPGSSDSPALASQVAGTTGACQHAWLIFVFLVERGFCHVGQAGLELLTSGDPPALASQSAGITGMSHCAQPCNFTFDGDLKCSMILYVARSNVSVFAELILGSTKKSLFPSHILYHISHLPQNLQLFGPGNDICCHFDDLKMVVGVEHSHEFRIPEHVDSHPSGKTRSLKRSLSKRKQFMLKKFLEKSLRIFDLSLDLMKLVVMMCIVCITVYEDGESSQHVWFILGIFREHFCCWHQVMNMVKKKTRFCLNIGKKSKLKGVIKTDKSSSYLCDDEAGSYTRKGWERLPGGTRGRSKHREPNRGLQCGTAARYVLGKMIGVLGDQAKRAGLGAVKYIFFFFLNKIMHWVNMYNAKLKICLSQVTLVNLSTTSFRTNLKNTLILSLNGHTLLTLLGACLSEAPRGRPSSIEGWGSPAPLQRPYSQTAAGSGRARAGRTAGSGAPLLRVVGGRSPILGPGPVEPLTGGRETAHPLEPTVRACRRRVTSLLQNWRSHRLKGRWQRLRERELAAGNQCSLPSELGVCSRFLGKCSAAATRFNGCCSLALNIEAKLPGVKINSMSIKDICPIPYSAVELMTGKHCAEVFGSSMAFFFFFFLTANGINLRYNSVSSSPVVFFQHVLLLPLTASVEPFLAMSAAIFNSQNNVMRVRKCTMKKQVSRREAPNSVQLARSSALKTRCDSEARFFFSLASLSILLSVPPQSLGLGRDKEYMDCSSTCCKHIHLSRAQVVRGVERTELEDSGCQSLLSLLLAVLEQWFLQVSRDRHILRSYPRPTESEIGGGAQQACSNLRAGRLQGSFRIYKRCFNSCCQSQKFHAEKPNLNDKGARLTLKITFFQIAIACQCSHSLCFYSFIFHYFKRRNCYEVYVQVRKFPGLRLFKTYNRPGTVAQACNPSTLGGRGGWITRSGVQDHPGQHGDTLSLLRIQNEPGMVAHACSPSYLRRLRQENSWNPGGRGCSELRLCHCTPAWVTEQDLVSKTKNKKTKLGIARAAHYLTFHGNFNSGILFQVVNIKSMCQCWWLSTLAAHNHFDAEATPSRVIQNPWRVGPDECFNVSRVIPMVAKVKNQYRTYKKVEKLISRTENLPLFQSTLKRHNWPLLLFPTSMNGQEKHHRESRVSAGTCIFVDDDLGYMFFHRLCFIGFVFSEALPHYIVLRIECGCLHGNEEVQQRLLVVVIIQAEKLHRQTYQFLPLQDITIEVGAKVIAVFAIKSNGTLLLHQPT

SEQ ID NO: 828703 - protein, 513 aa, Homo sapiens [sequence omitted]

SEQ ID NO: 828704 - protein, 739 aa, Homo sapiens
MKICLSQVTLVNLSTTSFRTNLKNTLILSLNGHTLLTLLGAYLSEAPRGRPSSIEGWGSPAPLQRPYSQTAAGSGRARAGRTAGSGAPLLRVVGGRSPILGPGPVEPLTGGRETAHPLEPTVRACRRRVTSLLQNWRSHRLKGRWQRLRERELAAGNQCSLPSELGVCSRFLGKCSAAATRFNGCCSLALNIEAKLPGVKINSMSIKDICPIPYSAVELMTGKHCAEVFGSSMAFFFFFFLTANGINLRYNSVSSSPVVFFQHVLLLPLTASVEPFLAMSAAIFNSQNNVMRVRKCTMKKQVSRREAPNSVQLARSSALKTRCDSEAEVFFLSCLTLNIAVSSSSIFRFGQGQRIHGLFLHMLQTHSPKQSTGSEMSRENWIRGFWMSVFAVTSFGSVLEQWFLQVSRDRHILRSYPRPTESEIGGGAQQACSNLRAGRLQGSFRIYKRCFNSCCQSQKFHAEKPNLNDKGARLTLKITFFQIAIACQCSHSLCFYSFIFHYFKRRNCYEVYVQVRKFPGLRLFKTYNRPGTVAQACNPSTLGGRGGWITRSGVQDHPGQHGDTLSLLKDTKLAGHGGTRLESQLPRRLRQENSWNPGGRGCSELRLCHCTPAWVTEQDLVSKTKNKKTKLGIARAAHYLTFHGNFNSGILFQVVNIKSMCQCWWLSTLAAHNHFDAEATPSRVIQNPWRVGPDECFNVSRVIPMVAKVKNQYRTYKKVEKLISRTENLPLFQEHSQAT

SEQ ID NO: 828705 - protein, 460 aa, Homo sapiens
MSIEIESSDVIRLIMQYLKENSLHRALATLQEETTVSLNTVDSIESFVADINSGHWDTVLQAIQSLKLPDKTLIDLYEQVVLELIELRELGAARSLLRQTDPMIMLKQTQPERYIHLENLLARSYFDPREAYPDGSSKEKRRAAIAQALAGEVSVVPPSRLMALLGQALKWQQHQGLLPPGMTIDLFRGKAAVKDVEEEKFPTQLSRHIKFGQKSHVECARFSPDGQYLVTGSVDGFIEVWNFTTGKIRKDLKYQAQDNFMMMDDAVLCMCFSRDTEMLATGAQDGKIKVWKIQSGQCLRRFERAHSKGVTCLSFSKDSSQILSASFDQTIRIHGLKSGKTLKEFRGHSSFVNEATFTQDGHYIISASSDGTVKIWNMKTTECSNTFKSLGSTAGTDITVNSVILLPKNPEHFVVCNRSNTVVIMNMQGQVSVQNVPLHRNCGPFPNQHFLVQAHPPNNQ

SEQ ID NO: 828706 - protein, 88 aa, Homo sapiens
RLIMQYLKENSLHRALATLQEETTVSLNTVDSIESFVADINSGHWDTVLQAIQSLKLPDKTLIDLYEQVRVVVMLIPMGWFVVGQLPN

SEQ ID NO: 828707 - protein, 513 aa, Homo sapiens [sequence omitted]

SEQ ID NO: 828708 - protein, 1276 aa, Homo sapiens
MLAFIRYKLVGKVFLKSFAVLLFTFLKIYFIFLRWSLALLPRLECSGAISANCNFHFPGSSDSPALASQVAGTTGACQHAWLIFVFLVERGFCHVGQAGLELLTSGDPPALASQSAGITGMSHCAQPCNFTFDGDLKCSMILYVARSNVSVFAELILGSTKKSLFPSHILYHISHLPQNLQLFGPGNDICCHFDDLKMVVGVEHSHEFRIPEHVDSHPSGKTRSLKRSLSKRKQFMLKKFLEKSLRIFDLSLDLMKLVVMMCIVCITVYEDGESSQHVWFILGIFREHFCCWHQVMNMVKKKTRFCLNIGKKSKLKGVIKTDKSSSYLCDDEAGSYTRKGWERLPGGTRGRSKHREPNRGLQCGTAARYVLGKMIGVLGDQAKRAGLGAVKYIFFFFLNKIMHWVNMYNAKLKICLSQVTLVNLSTTSFRTNLKNTLILSLNGHTLLTLLGACLSEAPRGRPSSIEGWGSPAPLQRPYSQTAAGSGRARAGRTAGSGAPLLRVVGGRSPILGPGPVEPLTGGRETAHPLEPTVRACRRRVTSLLQNWRSHRLKGRWQRLRERELAAGNQCSLPSELGVCSRFLGKCSAAATRFNGCCSLALNIEAKLPGVKINSMSIKDICPIPYSAVELMTGKHCAEVFGSSMAFFFFFFLTANGINLRYNSVSSSPVVFFQHVLLLPLTASVEPFLAMSAAIFNSQNNVMRVRKCTMKKQVSRREAPNSVQLARSSALKTRCDSEARFFFSLASLSILLSVPPQSLGLGRDKEYMDCSSTCCKHIHLSRAQVVRGVERTELEDSGCQSLLSLLLACARTVVLTSVTDRHILRSYPRPTESEIGGGAQQACSNLRAGRLQGSFRIYKRCFNSCCQSQKFHAEKPNLNDKGARLTLKITFFQIAIACQCSHSLCFYSFIFHYFKRRNCYEVYVQVRKFPGLRLFKTYNRPGTVAQACNPSTLGGRGGWITRSGVQDHPGQHGDTLSLLKDTKLAGHGGTRLESQLPRRLRQENSWNPGGRGCSELRLCHCTPAWVTEQDLVSKTKNKKTKLGIARAAHYLTFHGNFNSGILFQVVNIKSMCQCWWLSTLAAHNHFDAEATPSRVIQNPWRVGPDECFNVSRVIPMVAKVKNQYRTYKKVEKLISRTENLPLFQSTLKRHNWPLLLFPTSMNGQEKHHRESRVSAGTCIFVDDDLGYMFFHRLCFIGFVFSEALPHYIVLRIECGCLHGNEEVQQRLLVVVIIQAEKLHRQTYQFLPLQDITIMVGAKVIAVFAIKSNGTLLLHQPT

SEQ ID NO: 828709 - protein, 1008 aa, Homo sapiens
MKMENLVSTCWFILGIFREHFCCWHQVMNMVKKKTRFCLNIGKKSKLKGVIKTDKSSSYLCDDEAGSYTRKGWERLPGGTRGRSKHREPNRGLQCGTAARYVLGKMIGVLGDQAKRAGLGAVKYIFFFFLNKIMHWVNMYNAKLKICLSQVTLVNLSTTSFRTNLKNTLILSLNGHTLLTLLGASLSEAPRGRPSSIEGWGSPAPLQRPYSQTAAGSGRARAGRTAGSGAPLLRVVGGRSPILGPGPVEPLTGGRETAHPLEPTVRACRRRVTSLLQNWRSHRLKGRWQRLRERELAAGNQCSLPSELGVCSRFLGKCSAAATRFNGCCSLALNIEAKLPGVKINSMSIKDICPIPYSAVELMTGKHCAEVFGSSMAFFFFFFLTANGINLRYNSVSSSPVVFFQHVLLLPLTASVEPFLAMSAAIFNSQNNVMRVRKCTMKKQVSRREAPNSVQLARSSALKTRCDSEARFFFSLASLSILLSVPPQSLGLGRDKEYMDCSSTCCKHIHLSRAQVVRWVERTELEDSGCQSLLSLLLACARTVVLTSVTDRHILRSYPRPTESEIGGGAQQACSNLRAGRLQGSFRIYKRCFNSCCQSQKFHAEKPNLNDKGARLTLKITFFQIAIACQCSHSLCFYSFIFHYFKRRNCYEVYVQVRKFPGLRLFKTYNRPGTVAQACNPSTLGGRGGWITRSGVQDHPGQHGDTLSLLKDTKLAGHGGTRLESQLPRRLRQENSWNPGGRGCSELRLCHCTPAWVTEQDLVSKTKNKKTKLGIARAAHYLTFHGNFNSGILFQVVNIKSMCQCWWLSTLAAHNHFDAEATPSRVIQNPWRVGPDECFNVSRVIPMVAKVKNQYRTYKKVEKLISRTENLPLFQSTLKRHNWPLLLFPTSMNGQEKHHRESRVSAGTCIFVDDDLGYMFFHRLCFIGFVFSEALPHYIVLRIECGCLHGNEEVQQRLLVVVIIQAEKLHRQTYQFLPLQDITIEVGAKVIAVFAIKSNGTLLLHQPT

SEQ ID NO: 828710 - protein, 513 aa, Homo sapiens [sequence omitted]

SEQ ID NO: 828711 - protein, 199 aa, Homo sapiens
MSIEIESSDVIRLIMQYLKENSLHRALATLQEETTVSLNTVDSIESFVADINSGHWDTVLQAIQSLKLPDKTLIDLYEQVVLELIELRELGAARSLLRQTDPMIMLKQTQPERYIHLENLLARSYFDPREAYPDGSSKEKRRAAIAQALAGEVSVVPPSRLMALLGQALKWQQHQGLLPPGMTIDLFRGKAAPPIRGIL

SEQ ID NO: 828712 - protein, 209 aa, Homo sapiens
MVTFGQSGDCCTDSGTMNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTPTHY

SEQ ID NO: 828713 - protein, 114 aa, Homo sapiens
LGFEVVAHLSIHPSIQSSIHPSTHPPIYPPNYPFTSLFHSPVYPSTHSSIHPSTCPPNFSSTYPSTHPSIYPPLIHSSILPPRRVERSTRRGGGGDSCLTFILGRSVGNFGNHQ

SEQ ID NO: 828714 - protein, 114 aa, Homo sapiens
MTDHYCTIWPDPYLESRITGDIEDDDEEEEELESELELEALRRETLLLAVAEDDSVFSFAFLGGFLVELSCPLTSCNRFSNSRFFSKASSSFVFPTGFLMVEGFRGFLRRQERT

SEQ ID NO: 828715 - protein, 75 aa, Homo sapiens
HTPRTHIRRPHCTRRTRGGGNSEVTVDEVVAAHAEGPEQDYIWHCIDLFLDFITVFRKLMMILAMNEKDKKKEKK

SEQ ID NO: 828716 - protein, 117 aa, Homo sapiens
RIPVLTPQTAGVRFPTRLHSPSGPELFGRATRPFLPHCCLVCAQFLWDWAVSFPLERSSVVPLLTQPQISTVRPYKENGEPLLVDALLPLSCPCWSGKHTFLLCLHKSNVFPFPPLA

SEQ ID NO: 828717 - protein, 193 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTPTHY

SEQ ID NO: 828718 - protein, 193 aa, Homo sapiens; identical to SEQ ID NO: 828717

SEQ ID NO: 828719 - protein, 283 aa, Homo sapiens
GERKWARESTSGVRSAGRPWRGGLGSVDAGPLGLASIVRIQSTSFRGEGTRNSTHPIAVRLRAGPLVGLTLGERPGAKTESGDCCTDSGTMNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTPTHY

SEQ ID NO: 828720 - protein, 137 aa, Homo sapiens
MNIFDRKINFDALLKFSHITPSTQQHLKKVYASFALCMFGVGLGPALEFCIAVNPSILPTAFMGTAMIFTCFTLSALYARRRSYLFLGGILMSALSLLLLSSLGNVFFGSIWLFQANLYVGLVVMCGFVLFDTPTHY

SEQ ID NO: 828721 - protein, 193 aa, Homo sapiens; identical to SEQ ID NO: 828717

SEQ ID NO: 828722 - protein, 193 aa, Homo sapiens; identical to SEQ ID NO: 828717

SEQ ID NO: 828723 - protein, 193 aa, Homo sapiens; identical to SEQ ID NO: 828717

SEQ ID NO: 828724 - protein, 114 aa, Homo sapiens; identical to SEQ ID NO: 828713

SEQ ID NO: 828725 - protein, 175 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQATAN

SEQ ID NO: 828726 - protein, 75 aa, Homo sapiens; identical to SEQ ID NO: 828715

SEQ ID NO: 828727 - protein, 134 aa, Homo sapiens
KIRLVRGGGESAEAHDEKWDQQRAPTSGVRFPTRLHSPSGPELFGRATRPFLPHCCLVCAQFLWDWAVSFPLERSSVVPLLTQPQISTVRPYKENGEPLLVDALLPLSCPCWSGKHTFLLCLHKSNVFPFPPLA

SEQ ID NO: 828728 - protein, 193 aa, Homo sapiens; identical to SEQ ID NO: 828717

SEQ ID NO: 828729 - protein, 209 aa, Homo sapiens; identical to SEQ ID NO: 828712

SEQ ID NO: 828730 - protein, 193 aa, Homo sapiens; identical to SEQ ID NO: 828717

SEQ ID NO: 828731 - protein, 109 aa, Homo sapiens; identical to SEQ ID NO: 761274

SEQ ID NO: 828732 - protein, 193 aa, Homo sapiens; identical to SEQ ID NO: 828717

SEQ ID NO: 828733 - protein, 193 aa, Homo sapiens; identical to SEQ ID NO: 828717

SEQ ID NO: 828734 - protein, 193 aa, Homo sapiens; identical to SEQ ID NO: 828717

SEQ ID NO: 828735 - protein, 114 aa, Homo sapiens; identical to SEQ ID NO: 828713

SEQ ID NO: 828736 - protein, 727 aa, Homo sapiens
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITLQVVNMEEQPINIGELQLVQVPVPVTVPVATTSVEELQGAYENEVSKEGLAESEPMICHTLPLPEGFQVVKVGANGEVETLEQGELPPQEDPSWQKDPDYQPPAKKTKKTKKSKLRYTEEGKDVDVSVYDFEEEQQEGLLSEVNAEKVVGNMKPPKPTKIKKKGVKKTFQCELCSYTCPRRSNLDRHMKSHTDERPHKCHLCGRAFRTVTLLRNHLNTHTGTRPHKCPDCDMAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQPTAIIQVEDQNTGAIENIIVEVKKEPDAEPAEGEEEEAQPAATDAPNGDLTPEMILSMMDR

SEQ ID NO: 828737 - protein, 420 aa, Homo sapiens
KGTLLYLHTHSTRPHKCPDCDMAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQPTAIIQVEDQNTGAIENIIVEVKKEPDAEPAEGEEEEAQPAATDAPNGDLTPEMILSMMDR

SEQ ID NO: 828738 - protein, 587 aa, Homo sapiens
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITLQVVNMEEQPINIGELQLVQVPVPVTVPVATTSVEELQGAYENEVSKEGLAESEPMICHTLPLPEGFQVVKVGANGEVETLEQGELPPQEDPSWQKDPDYQPPAKKTKKTKKSKLRYTEEGKDVDVSVYDFEEEQQEGLLSEVNAEKVVGNMKPPKPTKIKKKGVKKTFQCELCSYTCPRRSNLDRHMKSHTDERPHKCHLCGRAFRTVTLLRNHLNTHTGTRPHKCPDCDMAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGLQHMHGIL

SEQ ID NO: 828739 - protein, 545 aa, Homo sapiens
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITLQVVNMEEQPINIGELQLVQVPVPVTVPVATTSVEELQGAYENEVSKEGLAESEPMICHTLPLPEGFQVVKVGANGEVETLEQGELPPQEDPSWQKDPDYQPPAKKTKKTKKSKLRYTEEGKDVDVSVYDFEEEQQEGLLSEVNAEKVVGNMKPPKPTKIKKKGVKKTFQCELCSYTCPRRSNLDRHMKSHTDERPHKCHLCGRAFRTVTLLRNHLNTHTGTRPHKCPDCDMAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQVGTFIESCWCFLGVWCYQRAFTYLVQWLFLKIVFSNCGL

SEQ ID NO: 828740 - protein, 727 aa, Homo sapiens; identical to SEQ ID NO: 828736

SEQ ID NO: 828741 - protein, 699 aa, Homo sapiens
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITLQVVNMEEQPINIGELQLVQVPVPVTVPVATTSVEELQGAYENEVSKEGLAESEPMICHTLPLPEGFQVVKVGANGEVETLEQGELPPQEDPSWQKDPDYQPPAKKTKKTKKSKLRYTEEGKDVDVSVYDFEEEQQEGLLSEVNAEKVVGNMKPPKPTKIKKKGVKKTFQCELCSYTCPRRSNLDRHMKSHTDERPHKCHLCGRAFRTVTLLRNHLNTHTGTRPHKCPDCDMAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQRKLFISALEAGVFSEHVGEPDGSLFFGDVGTKP

SEQ ID NO: 828742 - protein, 116 aa, Homo sapiens
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITFRKALFRHFIFISPLKFFY

SEQ ID NO: 828743 - protein, 235 aa, Homo sapiens [sequence omitted]

SEQ ID NO: 828744 - protein, 1855 aa, Homo sapiens
CSLHPAPCLDTGSLAAFFWGKPASCQPQLLPPPLATAPVLGVPWPRHPPDFSGSSAGKVAAPCVPPSNHELVPITTENAPKNVVDKGEGGSRGGNTRKSLEDNGSTRVTPSVQPHLQPIRNMSVSRTMEDSCELDLVYVTERIIAVSFPSTANEENFRSNLREVAQMLKSKHGGNYLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEEDEGKVVVRLSEEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGRRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 828745 - protein, 1855 aa, Homo sapiens; identical to SEQ ID NO: 828744

SEQ ID NO: 828746 - protein, 1752 aa, Homo sapiens
MVPFQQRKDCVLEGSTRVTPSVQPHLQPIRNMSVSRTMEDSCELDLVYVTERIIAVSFPSTANEENFRSNLREVAQMLKSKHGGNYLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGRRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 828747 - protein, 1119 aa, Homo sapiens
CGDLEDPDALSVGTGSGEPPFTDVGDPVPEKKSLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGRRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 828748 - protein, 405 aa, Homo sapiens
GRHLPTQPSHAAANPGPTATPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 828749 - protein, 312 aa, Homo sapiens
MYVLGEHNLTHNTFFPSPALDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 828750 - protein, 1855 aa, Homo sapiens; identical to SEQ ID NO: 828744

SEQ ID NO: 828751 - protein, 1855 aa, Homo sapiens; identical to SEQ ID NO: 828744

SEQ ID NO: 828752 - protein, 1855 aa, Homo sapiens; identical to SEQ ID NO: 828744

SEQ ID NO: 828753 - protein, 1855 aa, Homo sapiens; identical to SEQ ID NO: 828744

SEQ ID NO: 828754 - protein, 1663 aa, Homo sapiens
MVPFQQRKDCVLEGSTRVTPSVQPHLQPIRNMSVSRTMEDSCELDLVYVTERIIAVSFPSTANEENFRSNLREVAQMLKSKHGGNYLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGRRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRK

SEQ ID NO: 828755 - protein, 1082 aa, Homo sapiens
MVPFQQRKDCVLEGSTRVTPSVQPHLQPIRNMSVSRTMEDSCELDLVYVTERIIAVSFPSTANEENFRSNLREVAQMLKSKHGGNYLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGGELGRGKMGRGARGRRTPVVLDRNPGLRIWSAASFVPTLRSGLGWGSLCRGWG

SEQ ID NO: 828756 - protein, 37 aa, Homo sapiens
MEHLENGPSVSVDYNTSDPLIRWDSYDNFSGHRDDGM

SEQ ID NO: 828757 - protein, 82 aa, Homo sapiens
KNAHCPLHPAFLPGVQAREKQPAEPPAPLRRRAASDGQYENQSPEATSPRSPGVRSPVQCVSPELALTIALNPGGRPKEVSP

SEQ ID NO: 828758 - protein, 481 aa, Homo sapiens
SRPLAVCSFSCHRKCQAKVAAPCVPPSNHELVPITTENAPKNVVDKGEGGSRGGNTRKSLEDNGSTRVTPSVQPHLQPIRNMSVSRTMEDSCELDLVYVTERIIAVSFPSTANEENFRSNFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVYLYRWKYTLYFVSSCL

SEQ ID NO: 828759 - protein, 75 aa, Homo sapiens
CTHRDGIAVPRWGCTRRKFSDASLQWCELRHTGEPGSQPVVCARRLAQHLTLRPVLESSATFMGKHESGDKKALV

SEQ ID NO: 828760 - protein, 1744 aa, Homo sapiens
MVPFQQRKDCVLEGSTRVTPSVQPHLQPIRNMSVSRTMEDSCELDLVYVTERIIAVSFPSTANEENFRSNLREVAQMLKSKHGGNYLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGRRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 828761 - protein, 1777 aa, Homo sapiens
SRPLAVCSFSCHRKCQAKVAAPCVPPSNHELVPITTENAPKNVVDKGEGGSRGGNTRKSLEDNGSTRVTPSVQPHLQPIRNMSVSRTMEDSCELDLVYVTERIIAVSFPSTANEENFRSNFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGRRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 828762 - protein, 880 aa, Homo sapiens
MASELGGTAFSDGIRPIDHFLHKNAHCPLHPAFLPGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGRRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 828763 - protein, 235 aa, Homo sapiens [sequence omitted]

SEQ ID NO: 828764 - protein, 1855 aa, Homo sapiens; identical to SEQ ID NO: 828744

SEQ ID NO: 828765 - protein, 1855 aa, Homo sapiens; identical to SEQ ID NO: 828744

SEQ ID NO: 828766 - protein, 1855 aa, Homo sapiens; identical to SEQ ID NO: 828744

SEQ ID NO: 828767 - protein, 146 aa, Homo sapiens
RGRKTRWGASPLGRGGQQAGRCSLGWARSNPPLPAYPLGVHVCVSVVVFLCVCVYGCVFQSVFCLCVCVRAHQCVQAVFPHFSPPFRPIIENKCKKSLPTTLPASQALCGGNKITQHPSPPQLCIYIDGNILYILYHRAYSRCHRV

SEQ ID NO: 828768 - protein, 101 aa, Homo sapiens
MRIRLCPLASHPKEGGSLGLTAPCMYVCTHSMWGLDLCTHRDGIAVPRWGCTRRKFSDASLQWCELRHTGEPGSQPVVCARRLAQHLTLRPVLESSATFMG

SEQ ID NO: 828769 - protein, 99 aa, Homo sapiens
LLHLSESLMLRPAGGMGKRGWPETSLLTWAAVHLLGFHLPFPHARVPSPACRLFGFVARKQGSTTDNACHLFAELDPNQPASAIVNFVSKVMLNAGQKR

SEQ ID NO: 828770 - protein, 895 aa, Homo sapiens
MRMSVGLSLLLPLWGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 828771 - protein, 895 aa, Homo sapiens; identical to SEQ ID NO: 828770

SEQ ID NO: 828772 - protein, 893 aa, Homo sapiens
MSVGLSLLLPLWGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 828773 - protein, 353 aa, Homo sapiens
LRIPYRRSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 828774 - protein, 895 aa, Homo sapiens; identical to SEQ ID NO: 828770

SEQ ID NO: 828775 - protein, 895 aa, Homo sapiens; identical to SEQ ID NO: 828770

SEQ ID NO: 828776 - protein, 106 aa, Homo sapiens
EAGGARTASRRRAELAAGLAATLACQAVARLRPRAPPLRSAPSHRPVRARAKAAARRSRLLGLAVAAAAASRRIPGERRWRRPGARRSEHLPRSSRRRWGHCSPGR

SEQ ID NO: 828777 - protein, 531 aa, Homo sapiens
LGLASSHTQPTVPSTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 828778 - protein, 895 aa, Homo sapiens; identical to SEQ ID NO: 828770

SEQ ID NO: 828779 - protein, 642 aa, Homo sapiens
MPCGEDWLSHPLGIVQGFFAQNGVNPDWEKKVIEYFKEKLKENNAPKWVPSLNEVPLHYLKPNSFVKFRCMIQDMFDPEFYMGVYETVNQNTKAHVLHFGKYRDVAECGPQQELDLNSPRNTTLERQTFYCVPVPGESTWVKEAYVNANQARVSPSTSYTPSRHKRSYEDDDDMDLQPNKQKDQHAGARQAGSVGGLQWCGEPKRLETEASTGQQLNSLNLSSPFDLNFPLPGEKGPACLVKVYEDWDCFKVNDILELYGILSVDPVLSILNNDERDASALLDPMECTDTAEEQRVHSPPASLVPRIHVILAQKLQHINPLLPACLNKEESKTCKFVSSFMSELSPVRAELLGFLTHALLGDSLAAEYLILHLISTVYTRRDVLPLGKFTVNLSGCPRNSTFTEHLYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 828780 - protein, 191 aa, Homo sapiens
MGPSLRGCKCTYTYSLPPGPRYGEGIARRLPAALSNATIVGSDTASVRPQRHGPYGAARPTSSRRPRSTLRLGAAMLDYGPPSSEFGTRPVLSILNNDERDASALLDPMECTDTAEEQRVHSPPASLVPRIHVILAQKLQHINPLLPACLNKEESKTCKFVSSFMSELSPVRAELLGFLTHALLGDSLAAE

SEQ ID NO: 828781 - protein, 642 aa, Homo sapiens; identical to SEQ ID NO: 828779

SEQ ID NO: 828782 - protein, 390 aa, Homo sapiens
PWVYPAPPEYGISSPRSDLNNDERDASALLDPMECTDTAEEQRVHSPPASLVPRIHVILAQKLQHINPLLPACLNKEESKTCKFVSSFMSELSPVRAELLGFLTHALLGDSLAAEYLILHLISTVYTRRDVLPLGKFTVNLSGCPRNSTFTEHLYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 828783 - protein, 146 aa, Homo sapiens
MEFPCNINVFITSEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 828784 - protein, 146 aa, Homo sapiens
RAVYFNMLYLREWRSKERERAIGVWLVGGALRTHTHLSIQVCCLIWALLVVSRNNYNSNIKDHCSQLTISDEITKAVEDDFVEMRKNDPQSITADDLHQLLVVARCLSLSAGQTTLSRERWLRAKQLESLRRTRLQQQKCVNGNEL

SEQ ID NO: 828785 - protein, 534 aa, Homo sapiens
MPCGEDWLSHPLGIVQGFFAQNGVNPDWEKKVIEYFKEKLKENNAPKWVPSLNEVPLHYLKPNSFVKFRCMIQDMFDPEFYMGVYETVNQNTKAHVLHFGKYRDVAECGPQQELDLNSPRNTTLERQTFYCVPVPGESTWVKEAYVNANQARVSPSTSYTPSRHKRSYEDDDDMDLQPNKQKDQHAGARQAGSVGGLQWCGEPKRLETEASTGQQLNSLNLSSPFDLNFPLPGEKGPACLVKVYEDWDCFKVNDILELYGILSVDPVLSILNNDERDASALLDPMECTDTAEEQRVHSPPASLVPRIHVILAQKLQHINPLLPACLNKEESKTCKFVSSFMSELSPVRAELLGFLTHALLGDSLAAEYLILHLISTVYTRRDVLPLGKFTVNLSGCPRNSTFTEHLYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPQTARFTYSPNLACLGYRA

SEQ ID NO: 828786 - protein, 642 aa, Homo sapiens; identical to SEQ ID NO: 828779

SEQ ID NO: 828787 - protein, 123 aa, Homo sapiens
RLEDPLDVSEDWYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPV

SEQ ID NO: 828788 - protein, 469 aa, Homo sapiens
MDLQPNKQKDQHAGARQAGSVGGLQWCGEPKRLETEASTGQQLNSLNLSSPFDLNFPLPGEKGPACLVKVYEDWDCFKVNDILELYGILSVDPVLSILNNDERDASALLDPMECTDTAEEQRVHSPPASLVPRIHVILAQKLQHINPLLPACLNKEESKTCKFVSSFMSELSPVRAELLGFLTHALLGDSLAAEYLILHLISTVYTRRDVLPLGKFTVNLSGCPRNSTFTEHLYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 828789 - protein, 587 aa, Homo sapiens
MPCGEDWLSHPLGIVQGFFAQNGVNPDWEKKVIEYFKEKLKENNAPKWVPSLNEVPLHYLKPNSFVKFRCMIQDMFDPEFYMGVYETVNQNTKAHVLHFGKYRDVAECGPQQELDLNSPRNTTLERQTFYCVPVPGESTWVKEAYVNANQARVSPSTSYTPSRHKRSYEDDDDMDLQPNKQKDQHAGARQAGSVGGLQWCGEPKRLETEASTGQQLNSLNLSSPFDLNFPLPGEKGPACLVKVYEDWDCFKVNDILELYGILSVDPVLSILNNDERDASALLDPMECTDTAEEQRVHSPPASLVPRIHVILAQKLQHINPLLPACLNKEESKTCKFVSSFMSELSPVRAELLGFLTHALLGDSLAAEYLILHLISTVYTRRDVLPLGKFTVNLSGCPRNSTFTEHLYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPAVEDDFVEMRKNDPQSITADDLHQLLVVARCLSLSAGQTTLSRERWLRAKQLESLRRTRLQQQKCVNGNEL

SEQ ID NO: 828790 - protein, 150 aa, Homo sapiens
FLRVNNTPFKPRKKIHQEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 828791 - protein, 142 aa, Homo sapiens
MQTALFLRLASLTDGYVKLYLLSTELCFAHVVIFLPKTLERNWSVCPDSGLPFSFRSLFQVSCPNCLQSEQNFLGSLLMPFWGIVWLLNTLYYISSPQCKCCILVGIRGVWCVWKWKSGKIAGVICVFSLLGFITWFLSVQC

SEQ ID NO: 828792 - protein, 987 aa, Homo sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 828793 - protein, 935 aa, Homo sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGDLLRIGVTLAGHQKKILASVQHMKSQAKPGTPGGTGGPAPQY

SEQ ID NO: 828794 - protein, 509 aa, Homo sapiens
SLTLPACVLSLHLSPVLGTCSQEITVHCSKPGLGPPTGPSVSPDQQPFLSAESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 828795 - protein, 987 aa, Homo sapiens; identical to SEQ ID NO: 828792

SEQ ID NO: 828796 - protein, 107 aa, Homo sapiens
MSYVHRDLAARNILVNSNLVCKVSDFGLSRFLEENSSDPTYTSSLVMLGVILGVSFLGPGGQGRLERWEAEGLAALLQGEDTGAGCGWGDSQLQEADFQMSRKITVG

SEQ ID NO: 828797 - protein, 732 aa, Homo sapiens
MFLCMLLMNAFSLSACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 828798 - protein, 987 aa, Homo sapiens; identical to SEQ ID NO: 828792

SEQ ID NO: 828799 - protein, 893 aa, Homo sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGG

SEQ ID NO: 828800 - protein, 761 aa, Homo sapiens
MMDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828801 - protein, 761 aa, Homo sapiens; identical to SEQ ID NO: 828800

SEQ ID NO: 828802 - protein, 811 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828803 - protein, 811 aa, Homo sapiens; identical to SEQ ID NO: 828802

SEQ ID NO: 828804 - protein, 751 aa, Homo sapiens
RPAHGFSELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828805 - protein, 837 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKREIETFTQLDPNLFTPCPATYECPCFSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828806 - protein, 902 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKVSVFLLLSGCRSSNAVIELVGITVRSKPSQEKKGTMSIFCMLVISSFPRGVKSVNTTAKINIQGAWLLGLHLPHCFRKAGDILSVDLEFAAGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828807 - protein, 518 aa, Homo sapiens
MQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828808 - protein, 611 aa, Homo sapiens
YAQNCNRWDIYSTSSHSVKDMQDACPAEDVSTTGYLGCSRWIEAYWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828809 - protein, 761 aa, Homo sapiens; identical to SEQ ID NO: 828800

SEQ ID NO: 828810 - protein, 761 aa, Homo sapiens; identical to SEQ ID NO: 828800

SEQ ID NO: 828811 - protein, 403 aa, Homo sapiens
VLAVILCSMVGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828812 - protein, 822 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSGKGRGWSAQGCQTYYTCTAIPAWIQWQTSLIRLFPF

SEQ ID NO: 828813 - protein, 811 aa, Homo sapiens; identical to SEQ ID NO: 828802

SEQ ID NO: 828814 - protein, 375 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPLHFSSQQKSRFPCRLSADPSVTHCQSGQSLILRWESGRRLSLPFLCPDAEGWKSKSRCVAQNCSKER

SEQ ID NO: 828815 - protein, 700 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADAEGWKSKSRCVAQNCSKER

SEQ ID NO: 828816 - protein, 220 aa, Homo sapiens [sequence omitted]

SEQ ID NO: 828817 - protein, 266 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTHSRVLLY

SEQ ID NO: 828818 - protein, 772 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQRSPYMKVFHGFACWTSVLPTPKSLETILTHLITSSTNPHGKKCQFIFVCIGFLLGSSS

SEQ ID NO: 828819 - protein, 701 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHAGKQVKFNEFTHQLDLMQSFGV

SEQ ID NO: 828820 - protein, 701 aa, Homo sapiens; identical to SEQ ID NO: 828819

SEQ ID NO: 828821 - protein, 700 aa, Homo sapiens; identical to SEQ ID NO: 828815

SEQ ID NO: 828822 - protein, 671 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSIILGSYIRMLLDLNCDHLR

SEQ ID NO: 828823 - protein, 569 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGKHMFPAPGKGAAPGGEEGAGERPQENSAGRGNGANPGEGAQGRNPGTRGATEGDR

SEQ ID NO: 828824 - protein, 384 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTQVDALEM

SEQ ID NO: 828825 - protein, 761 aa, Homo sapiens; identical to SEQ ID NO: 828800

SEQ ID NO: 828826 - protein, 811 aa, Homo sapiens; identical to SEQ ID NO: 828802

SEQ ID NO: 828827 - protein, 735 aa, Homo sapiens
MLPLWRCLSTKKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828828 - protein, 518 aa, Homo sapiens; identical to SEQ ID NO: 828807

SEQ ID NO: 828829 - protein, 589 aa, Homo sapiens
PRGSDESYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828830 - protein, 572 aa, Homo sapiens
MHRTVTDGTLLHVFSLSERQCRMHAQQKMCPQRVILAAVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828831 - protein, 700 aa, Homo sapiens; identical to SEQ ID NO: 828815

SEQ ID NO: 828832 - protein, 286 aa, Homo sapiens
TPQLKGYPLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828833 - protein, 838 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEETGERHNGSVRPAPVHGRTSRWLVPVGRLSGHRGVPGLGLPKRRPLCVVSS

SEQ ID NO: 828834 - protein, 730 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADAEGLEKQSRCVGQTGPEDETVFPALWKGGDVFDGPGRLISHCSFEGTLP

SEQ ID NO: 828835 - protein, 136 aa, Homo sapiens
GRSNIRMRDCPDWQWVTEGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828836 - protein, 754 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 828837 - protein, 453 aa, Homo sapiens [sequence omitted]

SEQ ID NO: 828838 - protein, 367 aa, Homo sapiens
AGGEQAGERAGSSGSARARGRAAWAVGPACDARRRSVLPVTAAAAAAPDTCGGGGDPAAGAEMWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRNN

SEQ ID NO: 828839 - protein, 367 aa, Homo sapiens; identical to SEQ ID NO: 828838

SEQ ID NO: 828840 - protein, 367 aa, Homo sapiens; identical to SEQ ID NO: 828838

SEQ ID NO: 828841 - protein, 385 aa, Homo sapiens
AGGEQAGERAGSSGSARARGRAAWAVGPACDARRRSVLPVTAAAAAAPDTCGGGGDPAAGAEMWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRKAVEEPLNAFKESKGMMNDE

SEQ ID NO: 828842 - protein, 374 aa, Homo sapiens
AGGEQAGERAGSSGSARARGRAAWAVGPACDARRRSVLPVTAAAAAAPDTCGGGGDPAAGAEMWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRKAVEEPLNE

SEQ ID NO: 828843 - protein, 363 aa, Homo sapiens
AGGEQAGERAGSSGSARARGRAAWAVGPACDARRRSVLPVTAAAAAAPDTCGGGGDPAAGAEMWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVGFRGTPTVS

SEQ ID NO: 828844 - protein, 358 aa, Homo sapiens
AGGEQAGERAGSSGSARARGRAAWAVGPACDARRRSVLPVTAAAAAAPDTCGGGGDPAAGAEMWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAAGPTHGRPGGRVLGLQRLGRGYRGAANKTIPPRNN

SEQ ID NO: 828845 - protein, 374 aa, Homo sapiens; identical to SEQ ID NO: 828842

SEQ ID NO: 828846 - protein, 385 aa, Homo sapiens; identical to SEQ ID NO: 828841

SEQ ID NO: 828847 - protein, 355 aa, Homo sapiens
AGGEQAGERAGSSGSARARGRAAWAVGPACDARRRSVLPVTAAAAAAPDTCGGGGDPAAGAEMWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVE

SEQ ID NO: 828848 - protein, 355 aa, Homo sapiens; identical to SEQ ID NO: 828847

SEQ ID NO: 828849 - protein, 367 aa, Homo sapiens; identical to SEQ ID NO: 828838

SEQ ID NO: 828850 - protein, 385 aa, Homo sapiens; identical to SEQ ID NO: 828841

SEQ ID NO: 828851 - protein, 367 aa, Homo sapiens; identical to SEQ ID NO: 828838

SEQ ID NO: 828852 - protein, 367 aa, Homo sapiens; identical to SEQ ID NO: 828838

SEQ ID NO: 828853 - protein, 355 aa, Homo sapiens; identical to SEQ ID NO: 828847

SEQ ID NO: 828854 - protein, 367 aa, Homo sapiens; identical to SEQ ID NO: 828838

SEQ ID NO: 828855 - protein, 367 aa, Homo sapiens; identical to SEQ ID NO: 828838

SEQ ID NO: 828856 - protein, 367 aa, Homo sapiens; identical to SEQ ID NO: 828838

SEQ ID NO: 828857 - protein, 363 aa, Homo sapiens; identical to SEQ ID NO: 828843

SEQ ID NO: 828858 - protein, 360 aa, Homo sapiens
AGGEQAGERAGSSGSARARGRAAWAVGPACDARRRSVLPVTAAAAAAPDTCGGGGDPAAGAEMWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASIRRL

SEQ ID NO: 828859 - protein, 123 aa, Homo sapiens
MTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLETADPIHSAVH

SEQ ID NO: 828860 - protein, 123 aa, Homo sapiens; identical to SEQ ID NO: 828859

SEQ ID NO: 828861 - protein, 213 aa, Homo sapiens
MARYEAGVGGTQPCCPGTKTNSPKIRSYVEDRASWCTGWPWTSLPLAAVASLPALGGGASVSLRCWAADRPNRHAWYPRGVRQETTKTDAMTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLETADPIHSAVH

SEQ ID NO: 828862 - protein, 238 aa, Homo sapiens
AARGHFRCCFCEFFRCTRVLLKRQLRSPRSAEPAEPQPCCPGTKTNSPKIRSYVEDRASWCTGWPWTSLPLAAVASLPALGGGASVSLRCWAADRPNRHAWYPRGVRQETTKTDAMTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLETADPIHSAVH

SEQ ID NO: 828863 - protein, 127 aa, Homo sapiens
MLGYRTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLETADPIHSAVH

SEQ ID NO: 828864 - protein, 127 aa, Homo sapiens; identical to SEQ ID NO: 828863

SEQ ID NO: 828865 - protein, 71 aa, Homo sapiens
AARGHFRCCFCEFFRCTRVLLKRQLRSPRSAEPAEPQPWRRSPMGLRLVPAASHTRQGPRGAFGIWGLWGT

SEQ ID NO: 828866 - protein, 123 aa, Homo sapiens; identical to SEQ ID NO: 828859

SEQ ID NO: 828867 - protein, 123 aa, Homo sapiens; identical to SEQ ID NO: 828859

SEQ ID NO: 828868 - protein, 123 aa, Homo sapiens; identical to SEQ ID NO: 828859

SEQ ID NO: 828869 - protein, 123 aa, Homo sapiens; identical to SEQ ID NO: 828859

SEQ ID NO: 828870 - protein, 123 aa, Homo sapiens; identical to SEQ ID NO: 828859

SEQ ID NO: 828871 - protein, 123 aa, Homo sapiens; identical to SEQ ID NO: 828859

SEQ ID NO: 828872 - protein, 200 aa, Homo sapiens
SLGTRPGVGGTQPCCPGTKTNSPKIRSYVEDRASWCTGWPWTSLPLAAVASLPALGGGASVSLRCWAADRPNRHAWYPRGVRQETTKTDAMTEADVNPKAYPLADAHLTKKLLDLVQQSCNYKQLRKGANEASHWRSFCTCRCCVKTRMCPTCLCAPSRPWGEPVGSPGLSSPVLSPSKKARSLKQQIQSIQQSIERLLV

SEQ ID NO: 828873 - protein, 110 aa, Homo sapiens
MTEADVNPKAYPLADAHLTKKLLDLVQQSCNYKQLRKGANEASHWRSFCTCRCCVKTRMCPTCLCAPSRPWGEPVGSPGLSSPVLSPSKKARSLKQQIQSIQQSIERLLV

SEQ ID NO: 828874 - protein, 238 aa, Homo sapiens; identical to SEQ ID NO: 828862

SEQ ID NO: 828875 - protein, 123 aa, Homo sapiens; identical to SEQ ID NO: 828859

SEQ ID NO: 828876 - protein, 158 aa, Homo sapiens
LSPLCHLTVVVAGSGCGGASSAGRPLPHPSARARARSPPLPPLRTPVGYGKVQAAAGCPRAVVAAVATGPNGAAESLSGEALRVRPVQRPGPAAQPHHAGEGHCLGLQTLWLMWGVQKSQKKSFWSTSPPWGSPCSEVRPTTSLNTIVTPSATKWHSS

SEQ ID NO: 828877 - protein, 168 aa, Homo sapiens
MEPPNLYPVKLYVYDLSKGLARRLSPIMLGKQLEGIWHTSIVVHKDEFFFGSGGISSCPPGGTLLGPPDSVVDVGSTEVTEEIFLEYLSSLGESLFRGEAYNLFEHNCNTFSNEVAQFLTGRKIPSYITDLPSEVLSTPFGQALRPLLDSIQIQPPGGSSVGRPNGQS

SEQ ID NO: 828878 - protein, 168 aa, Homo sapiens; identical to SEQ ID NO: 828877

SEQ ID NO: 828879 - protein, 168 aa, Homo sapiens; identical to SEQ ID NO: 828877

SEQ ID NO: 828880 - protein, 143 aa, Homo sapiens
FSGLLCLSLCDRHTSIVVHKDEFFFGSGGISSCPPGGTLLGPPDSVVDVGSTEVTEEIFLEYLSSLGESLFRGEAYNLFEHNCNTFSNEVAQFLTGRKIPSYITDLPSEVLSTPFGQALRPLLDSIQIQPPGGSSVGRPNGQS

SEQ ID NO: 828881 - protein, 158 aa, Homo sapiens; identical to SEQ ID NO: 828876

SEQ ID NO: 828882 - protein, 168 aa, Homo sapiens; identical to SEQ ID NO: 828877

SEQ ID NO: 828883 - protein, 168 aa, Homo sapiens; identical to SEQ ID NO: 828877

SEQ ID NO: 828884 - protein, 120 aa, Homo sapiens
QVSQAQQGGLFFISEEAPPRKSLHRKQDCCGRLALWTGTSAPPGLHSDPASRRELRGQTQRPELTGLPGTALPHQGFSFLNKTNPTRFLFYNFTSELTTRGRLFKFPREGDRQAACRQCC

SEQ ID NO: 828885 - protein, 168 aa, Homo sapiens; identical to SEQ ID NO: 828877

SEQ ID NO: 828886 - protein, 168 aa, Homo sapiens; identical to SEQ ID NO: 828877

SEQ ID NO: 828887 - protein, 168 aa, Homo sapiens; identical to SEQ ID NO: 828877

SEQ ID NO: 828888 - protein, 138 aa, Homo sapiens
MEPPNLYPVKLYVYDLSKGLARRLSPIMLGKQLEGIWHTSIVVHKDEFFFGSGGISSCPPGGTLLGPPDSVVDVGSTEVTEEIFLEYLSSLGESLFRGEAYNLFEHNCNTFSNEVAQFLTGRKIPSYITDLPSEVLST

SEQ ID NO: 828889 - protein, 116 aa, Homo sapiens
LSPLCHLTVVVAGSGCGGASSAGRPLPHPSARARARSPPLPPLRTPVGYGKVQAAAGCPRAVVAAVATGPNGAAESLSGEALRVRPVQRPGPAAQPHHAGETTGRHLAHIHSCAQG

SEQ ID NO: 828890 - protein, 106 aa, Homo sapiens
MASREAPRQSVEGKRRIKGEGSTLVCIFQSLPAQSPGLHLCLRSCSPSHSQTFPKPPDVPQYKPGPSRPHPAGLFSSVFLLFSPFLQNTHTHTHTLLSCKNTHIPF

SEQ ID NO: 828891 - protein, 184 aa, Homo sapiens
CVPGPRPSGVSCADRSEGSWPTAPSRSLPPPSTLSVVEKMVGRNSAIAAGVCGALFIGYCIYFDRKRRSDPNFKNRLRERRKKQKLAKERAGLSKLPDLKDAEAVQKFFLEEIQLGEELLAQGEYEKGVDHLTNAIAVCGQPQQLLQVLQQTLPPPVFQMLLTKLPTISQRIVSAQSLAEDDVE

SEQ ID NO: 828892 - protein, 4027 aa, Homo sapiens
MHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQLSLLPLMEPIIGVNFAHFLPYGSGQFNSGNRLLGTFGSATLEGVSDYYSQLIYKQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 828893 - protein, 4027 aa, Homo sapiens; identical to SEQ ID NO: 828892

SEQ ID NO: 828894 - protein, 4027 aa, Homo sapiens; identical to SEQ ID NO: 828892

SEQ ID NO: 828895 - protein, 4027 aa, Homo sapiens; identical to SEQ ID NO: 828892

SEQ ID NO: 828896 - protein, 4027 aa, Homo sapiens; identical to SEQ ID NO: 828892

SEQ ID NO: 828897 - protein, 4027 aa, Homo sapiens; identical to SEQ ID NO: 828892

SEQ ID NO: 828898 - protein, 4027 aa, Homo sapiens; identical to SEQ ID NO: 828892

SEQ ID NO: 828899 - protein, 4367 aa, Homo sapiens
MDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQLSLLPLMEPIIGVNFAHFLPYGSGQFNSGNRLLGTFGSATLEGVSDYYSQLIYKQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVI

SEQ ID NO: 828900 - protein, 4260 aa, Homo sapiens
LGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQLSLLPLMEPIIGVNFAHFLPYGSGQFNSGNRLLGTFGSATLEGVSDYYSQLIYKQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPQSHFRAQSLEN

SEQ ID NO: 828901 - protein, 2665 aa, Homo sapiens
GACARKGGGSEQINFSDAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQLSLLPLMEPIIGVNFAHFLPYGSGQFNSGNRLLGTFGSATLEGVSDYYSQLIYKQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 828902 - protein, 4350 aa, Homo sapiens
MDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQLSLLPLMEPIIGVNFAHFLPYGSGQFNSGNRLLGTFGSATLEGVSDYYSQLIYKQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNAVTRQDSVASD

SEQ ID NO: 828903 - protein, 3315 aa, Homo sapiens
LGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLVSVNHKNDNFFLLF

SEQ ID NO: 828904 - protein, 1723 aa, Homo sapiens
MMHFVIQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQLSLLPLMEPIIGVNFAHFLPYGSGQFNSGNRLLGTFGSATLEGVSDYYSQLIYKQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 828905 - protein, 1140 aa, Homo sapiens [sequence omitted]

SEQ ID NO: 828906 - protein, 215 aa, Homo sapiens [sequence omitted]

SEQ ID NO: 828907 - protein, 2738 aa, Homo sapiens
LGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQVINRFAK

SEQ ID NO: 828908 - protein, 2099 aa, Homo sapiens
LGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGTAVSGQTVTSTLTPLITHVTTLHGSSV

SEQ ID NO: 828909 - protein, 732 aa, Homo sapiens
LGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSRGNTNLFSMKYVCKN

SEQ ID NO: 828910 - protein, 542 aa, Homo sapiens
LGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWYSRVCLPC

SEQ ID NO: 828911 - protein, 508 aa, Homo sapiens
MLPTQAGAAAALGRGSALGGSLNRTPTGRPGGGGGTRGANGGRVPGNGAGLGPGRLEREAAAAAATTPAPTAGALYSGSEGDSESGEEEELGAERRGLKRSLSEMEIGMVVGGPEASAAATGGYGPVSGAVSGAKPGKKTRGRVKIKMEFIDNKLRRYTTFSKRKTGIMKKAYELSTLTGTQVLLLVASETGHVYTFATRKLQPMITSETGKALIQTCLNSPDSPPRSDPTTDQRMSATGFEETDLTYQVSESDSSGETKDTLKPAFTVTNLPGTTSTIQTAPSTSTTMQVSSGPSFPITNYLAPVSASVSPSAVSSANGTVLKSTGSGPVSSGGLMQLPTSFTLMPGGAVAQQVPVQAIQVHQAPQQASPSRDSSTDLTQTSSSGTVTLPATIMTSSVPTTVGGHMMYPSPHAVMYAPTSGLGDGSLTVLNAFSQAPSTMQVSHSQVQEPGGVPQVFLTASSGTVQIPVSAVQLHQMAVIGQQAGSSSNLTELQVVNLDTAHSTKSE

SEQ ID NO: 828912 - protein, 508 aa, Homo sapiens; identical to SEQ ID NO: 828911

SEQ ID NO: 828913 - protein, 362 aa, Homo sapiens
RNRGERRRGGSDRRQRGRGPLLSEGAYELSTLTGTQVLLLVASETGHVYTFATRKLQPMITSETGKALIQTCLNSPDSPPRSDPTTDQRMSATGFEETDLTYQVSESDSSGETKDTLKPAFTVTNLPGTTSTIQTAPSTSTTMQVSSGPSFPITNYLAPVSASVSPSAVSSANGTVLKSTGSGPVSSGGLMQLPTSFTLMPGGAVAQQVPVQAIQVHQAPQQASPSRDSSTDLTQTSSSGTVTLPATIMTSSVPTTVGGHMMYPSPHAVMYAPTSGLGDGSLTVLNAFSQAPSTMQVSHSQVQEPGGVPQVFLTASSGTVQIPVSAVQLHQMAVIGQQAGSSSNLTELQVVNLDTAHSTKSE

SEQ ID NO: 828914 - protein, 508 aa, Homo sapiens; identical to SEQ ID NO: 828911

SEQ ID NO: 828915 - protein, 508 aa, Homo sapiens; identical to SEQ ID NO: 828911

SEQ ID NO: 828916 - protein, 508 aa, Homo sapiens; identical to SEQ ID NO: 828911

SEQ ID NO: 828917 - protein, 180 aa, Homo sapiens
MLPTQAGAAAALGRGSALGGSLNRTPTGRPGGGGGTRGANGGRVPGNGAGLGPGRLEREAAAAAATTPAPTAGALYSGSEGDSESGEEEELGAERRGLKRSLSEMEIGMVVGGPEASAAATGGYGPVSGAVSGAKPGKKTRGRVKIKMEFIDNKLRRYTTLGVSLPRWLWGMCVWVCAPE

SEQ ID NO: 828918 - protein, 102 aa, Homo sapiens
LTWEMARGLWGPGIPRDGMGVISGDQCRADTCLCLPVTLPATIMTSSVPTTVGGHMMYPSPHAVMYAPTSGLGDGSLTVLNAFSQAPSTMQVSHSQVQEPGE

SEQ ID NO: 828919 - protein, 105 aa, Homo sapiens
APSTSTTMQVSSGPSFPITNYLAPVSASVSPSAVSSANGTVLKSTGSGPVSSGGLMQLPTSFTLMPGESRGAGRDSSFLGQIKHAKSVFRAGTKRTSFPAQKEGE

SEQ ID NO: 828920 - protein, 729 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 828921 - protein, 729 aa, Homo sapiens; identical to SEQ ID NO: 828920

SEQ ID NO: 828922 - protein, 729 aa, Homo sapiens; identical to SEQ ID NO: 828920

SEQ ID NO: 828923 - protein, 711 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 828924 - protein, 729 aa, Homo sapiens; identical to SEQ ID NO: 828920

SEQ ID NO: 828925 - protein, 752 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKLPIARGALLLARPDQRCNAGFWQELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 828926 - protein, 768 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTGGPWTGSLATWCTQEGGGKWPSDHKVSCTLMIFLGPLFPEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 828927 - protein, 359 aa, Homo sapiens
MQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 828928 - protein, 729 aa, Homo sapiens; identical to SEQ ID NO: 828920

SEQ ID NO: 828929 - protein, 139 aa, Homo sapiens
LRSRSEFPRVTKRLCKVGGSSSPVEKEVVEATDSREKTGMELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 828930 - protein, 639 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKVSLRCGFLL

SEQ ID NO: 828931 - protein, 427 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRSAQLSKATRF

SEQ ID NO: 828932 - protein, 126 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPEG

SEQ ID NO: 828933 - protein, 729 aa, Homo sapiens; identical to SEQ ID NO: 828920

SEQ ID NO: 828934 - protein, 427 aa, Homo sapiens; identical to SEQ ID NO: 828931

SEQ ID NO: 828935 - protein, 473 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVHPPPAMRVQTRPLRSAVLSTRHCARLSAQPTRRGPPALSPPTSPRCFLERMTACCVLTAYATTVLSVIWVLSSAQACCTWLRMGC

SEQ ID NO: 828936 - protein, 729 aa, Homo sapiens; identical to SEQ ID NO: 828920

SEQ ID NO: 828937 - protein, 729 aa, Homo sapiens; identical to SEQ ID NO: 828920

SEQ ID NO: 828938 - protein, 729 aa, Homo sapiens; identical to SEQ ID NO: 828920

SEQ ID NO: 828939 - protein, 118 aa, Homo sapiens
ARYELGCVMAEGERELSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 828940 - protein, 610 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTGGPWTGSLATWCTQEGGGKWPSDHKVSCTLMIFL

SEQ ID NO: 828941 - protein, 422 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQVSWEHPCRILYLILLRGCNRQFSHVVPWCSSLAWLGQAAWAWVARFLCLI

SEQ ID NO: 828942 - protein, 116 aa, Homo sapiens
AGETVSFSWRSYWRSCLCSCPVSDGAEEAAGSCAQAPSHSPPNKPKLVVKPPGSSLNGVHPNPTPIVQRLPAFLDNHNYAKSPMQVSWEHPCRILYLILLRGCNRQFSHVVPWCSS

SEQ ID NO: 828943 - protein, 491 aa, Homo sapiens
RRVPSSAVGAAVRRQETSAPRCTRPSRRQRGYCQQRRRLPRSAPTAPARPCRAERGSGGGMLALLAASVALAVAAGAQDSPAPGSRFVCTALPPEAVHAGCPLPAMPMQGGAQSPEEELRAAVLQLRETVVQQKETLGAQREAIRELTGKLARCEGLAGGKARGAGATGKDTMGDLPRDPGHVVEQLSRSLQTLKDRLESLEHQLRANVSNAGLPGDFREVLQQRLGELERQLLRKVAELEDEKSLLHNETSAHRQKTESTLNALLQRVTELERGNSAFKSPDAFKVSLPLRTNYLYGKIKKTLPELYAFTICLWLRSSASPGIGTPFSYAVPGQANEIVLIEWGNNPIELLINDKVAQLPLFVSDGKWHHICVTWTTRDGMWEAFQDGEKLGTGENLAPWHPIKPGGVLILGQEQDTVGGRFDATQAFVGELSQFNIWDRVLRAQEIVNIANCSTNMPGNIIPWVDNNVDVFGGASKWPVETCEERLLDL

SEQ ID NO: 828944 - protein, 491 aa, Homo sapiens; identical to SEQ ID NO: 828943

SEQ ID NO: 828945 - protein, 333 aa, Homo sapiens
RRVPSSAVGAAVRRQETSAPRCTRPSRRQRGYCQQRRRLPRSAPTAPARPCRAERGSGGGMLALLAASVALAVAAGAQDSPAPGSRFVCTALPPEAVHAGCPLPAMPMQGGAQSPEEELRAAVLQLRETVVQQKETLGAQREAIRELTGKLARCEGLAGGKARGAGATGKDTMGDLPRDPGHVVEQLSRSLQTLKDRLESLEHQLRANVSNAGLPGDFREVLQQRLGELERQLLRKVAELEDEKSLLHNETSAHRQKTESTLNALLQRVTELERGNSAFKSPDAFKVSLPLRTNYLYGKIKKTLPELYAFTICLWLRSSASPGIGTPSSPGAC

SEQ ID NO: 828946 - protein, 125 aa, Homo sapiens
NSAFKSPDAFKVSLPLRTNYLYGKIKKTLPELYAFTICLWLRSSASPGIGTPFSYAVPGQANEIVLIEWGNNPIELLINDKVRPACTATLPRTHHVVEGATAPTPAVLALLGPHSSVPDMGLRGC

SEQ ID NO: 828947 - protein, 177 aa, Homo sapiens [sequence omitted]

SEQ ID NO: 828948 - protein, 388 aa, Homo sapiens
LPGRRGRGLRGLRGCRGARGAGKAHLGWPWRAGGDMEDGVLKEGFLVKRGHIVHNWKARWFILRQNTLVYYKLEGGRRVTPPKGRILLDGCTITCPCLEYENRPLLIKLKTQTSTEYFLEACSREERDAWAFEITGAIHAGQPGKVQQLHSLRNSFKLPPHISLHRIVDKMHDSNTGIRSSPNMEQGSTYKKTFLGSSLVDWLISNSFTASRLEAVTLASMLMEENFLRPVGVRSMGAIRSGDLAEQFLDDSTALYTFAESYKKKISPKEEISLSTVELSGTVVKQGYLAKQGHKRKNWKVRRFVLRKDPAFLHYYDPSKEENRPVGGFSLRGSLVSALEDNGVPTGVKGNVQGNLFKVITKDDTHYYIQASSKAERAEWIEAIKKLT

SEQ ID NO: 828949 - protein, 388 aa, Homo sapiens; identical to SEQ ID NO: 828948

SEQ ID NO: 828950 - protein, 396 aa, Homo sapiens
LPGRRGRGLRGLRGCRGARGAGKAHLGWPWRAGGDMEDGVLKEGFLVKRGHIVHNWKARWFILRQNTLVYYKLEGGRRVTPPKGRILLDGCTITCPCLEYENRPLLIKLKTQTSTEYFLEACSREERDAWAFEITGAIHAGQPGKVQQLHSLRNSFKLPPHISLHRIVDKMHDSNTGIRSSPNMEQGSTYKKTFLGSSLVDWLISNSFTASRLEAVTLASMLMEENFLRPVGVRSMGAIRSGDLAEQFLDDSTALYTFAESYKKKISPKEEISLSTVELSGTVVKQGYLAKQGHKRKNWKVRRFVLRKDPAFLHYYDPSKEENRPVGGFSLRGSLVSALEDNGVPTGVKGNVQGNLFKVITKDDTHYYIQASSKAERAEWIEAIMTQTRVPGEWEC

SEQ ID NO: 828951 - protein, 140 aa, Homo sapiens [sequence omitted]

SEQ ID NO: 828952 - protein, 140 aa, Homo sapiens [sequence omitted]

SEQ ID NO: 828953 - protein, 79 aa, Homo sapiens
MCLGFFSPVPGSTSSATNVSMVVSADPLSSERAEMNILEINQELRSQLAESNQQFRDLKEKFLISQATAYSLANQLKKY

SEQ ID NO: 828954 - protein, 43 aa, Homo sapiens
MTMTTMTASSSSWSWKDKVLWRRGGNSDSLGLHHLLHRRDEVV

SEQ ID NO: 828955 - protein, 261 aa, Homo sapiens
WRGEVFVEESAAGEQSSGTQIPRHLEEKDLKPIFEQFGRIFELTVIKDKYTGLHKGEGSGRLKRLRGGLGGWGKLSQAGGVERLGRADVEGEEFRPEEKWMEELKKNSARVIRKPRWRTKEGLFWLKSCQDGCKDVDPRHMGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPVSPTPL

SEQ ID NO: 828956 - protein, 472 aa, Homo sapiens
WRGEVFVEESAAGEQSSGTQIPRHLEEKDLKPIFEQFGRIFELTVIKDKYTGLHKGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 828957 - protein, 396 aa, Homo sapiens
QGGQKEGHLERTPTGHQPTESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 828958 - protein, 259 aa, Homo sapiens
MKEPDAIKLFVGQIPRHLEEKDLKPIFEQFGRIFELTVIKDKYTGLHKGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSAL

SEQ ID NO: 828959 - protein, 116 aa, Homo sapiens
SHGLSISFLIPFGFLYGLPPPSCLLYPCSHGWGWGQMGPFGLRPDDLPSSGSPILDAVTHPSPLPSPRARDPHRGSLPHASPMFLPSQVWRSQRKGRLTPSSHDWPRPSPHTCPGP

SEQ ID NO: 828960 - protein, 109 aa, Homo sapiens
MKEPDAIKLFVGQIPRHLEEKDLKPIFEQFGRIFELTVIKDKYTGLHKGEGSGRLKRLRGGLGGWGKLSQAGGVERLGRADVEGEEFRPEEKWMEELKKNSARVIRKPR

SEQ ID NO: 828961 - protein, 116 aa, Homo sapiens; identical to SEQ ID NO: 828959

SEQ ID NO: 828962 - protein, 465 aa, Homo sapiens
MKEPDAIKLFVGQIPRHLEEKDLKPIFEQFGRIFELTVIKDKYTGLHKGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 828963 - protein, 365 aa, Homo sapiens
MLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 828964 - protein, 465 aa, Homo sapiens; identical to SEQ ID NO: 828962

SEQ ID NO: 828965 - protein, 465 aa, Homo sapiens; identical to SEQ ID NO: 828962

SEQ ID NO: 828966 - protein, 85 aa, Homo sapiens
VPRAASLQSPSRCPLQLPVPPGGAVSKAGPDAWCHQRGLEPGPRALAEENESRQRRWPRLAARKQWGGQQGDIGLFPGAWGTDGD

SEQ ID NO: 828967 - protein, 112 aa, Homo sapiens
RRGERKWRCQNLSTAPAQSSPEVLRREHSCPRGLGGRDLCTATQPRSRVHAYARVYVLCVFADVCPCVCVCVVAVPGESDLRRCCGEGCKVLAGGGTPHASPWAGLFLAGEC

SEQ ID NO: 828968 - protein, 344 aa, Homo sapiens
GGEGAAAGGCEERPAGGGGRRAAMAAAEAGGDDARCVRLSAERAQALLADVDTLLFDCDGVLWRGETAVPGAPEALRALRARGKRLGFITNNSSKTRAAYAEKLRRLGFGGPAGPGASLEVFGTAYCTALYLRQRLAGAPAPKAYVLGSPALAAELEAVGVASVGVGPEPLQGEGPGDWLHAPLEPDVRAVVVGFDPHFSYMKLTKALRYLQQPGCLLVGTNMDNRLPLENGRFIAGTGCLVRAVEMAAQRQADIIGKPSRFIFDCVSQEYGINPERTVMVGDRLDTDILLGATCGLKTILTLTGVSTLGDVKNNQESDCVSKKKMVPDFYVDSIADLLPALQG

SEQ ID NO: 828969 - protein, 315 aa, Homo sapiens
RGGRRGGRLRGAAGGRRRPAGGDGGGGGRWRRRPLRAAERRAGTGAAGRRGHAAVRLRRRAVARGDRRAWRARGPAGAASPRQAPGLHHQQQQQDPRCLRREAAAPGLRRPRGARRQPGGLRHGLLHRALPAPAVGVGPEPLQGEGPGDWLHAPLEPDVRAVVVGFDPHFSYMKLTKALRYLQQPGCLLVGTNMDNRLPLENGRFIAGTGCLVRAVEMAAQRQADIIGKPSRFIFDCVSQEYGINPERTVMVGDRLDTDILLGATCGLKTILTLTGVSTLGDVKNNQESDCVSKKKMVPDFYVDSIADLLPALQG

SEQ ID NO: 828970 - protein, 344 aa, Homo sapiens; identical to SEQ ID NO: 828968

SEQ ID NO: 828971 - protein, 344 aa, Homo sapiens; identical to SEQ ID NO: 828968

SEQ ID NO: 828972 - protein, 372 aa, Homo sapiens
GGEGAAAGGCEERPAGGGGRRAAMAAAEAGGDDARCVRLSAERAQALLADVDTLLFDCDGVLWRGETAVPGAPEALRALRARGKRLGFITNNSSKTRAAYAEKLRRLGFGGPAGPGASLEVFGTAYCTALYLRQRLAGAPAPKAYVLGSPALAAELEAVGVASVGVGPEPLQGEGPGDWLHAPLEPDVRAVVVGFDPHFSYMKLTKALRYLQQPGCLLVGTNMDNRLPLENGRFIAGPCALGREAGGRAAGPLPAPLTRSPVPRGTGCLVRAVEMAAQRQADIIGKPSRFIFDCVSQEYGINPERTVMVGDRLDTDILLGATCGLKTILTLTGVSTLGDVKNNQESDCVSKKKMVPDFYVDSIADLLPALQG

SEQ ID NO: 828973 - protein, 351 aa, Homo sapiens
GGEGAAAGGCEERPAGGGGRRAAMAAAEAGGDDARCVRLSAERAQALLADVDTLLFDCDGVLWRGETAVPGAPEALRALRARGKRLGFITNNSSKTRAAYAEKLRRLGFGGPAGPGASLEVFGTAYCTALYLRQRLAGAPAPKAYVLGSPALAAELEAVGVASVGVGPEPLQGEGPGDWLHAPLEPDVRAVVVGFDPHFSYMKLTKALRYLQQPGCLLVGTNMDNRLPLENGRFIADGCLAEPPRVWVEKGKNMAAQRQADIIGKPSRFIFDCVSQEYGINPERTVMVGDRLDTDILLGATCGLKTILTLTGVSTLGDVKNNQESDCVSKKKMVPDFYVDSIADLLPALQG

SEQ ID NO: 828974 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 828975 - protein, 657 aa, Homo sapiens
QALHPHFPIEETEAEEAQRATGGPTVPPSLGSTQTMALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 828976 - protein, 677 aa, Homo sapiens
QALHPHFPIEETEAEEAQRHALLFLPGRPLPSAVTRGQRATGGPTVPPSLGSTQTMALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 828977 - protein, 630 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 828978 - protein, 317 aa, Homo sapiens
IQIRSVPLLGSLLKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 828979 - protein, 340 aa, Homo sapiens
FRESLIGRAGLRQLADKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 828980 - protein, 631 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQGGRGGQARAGGRAGGVEVGALSHPSLCRRPSRGRPAS

SEQ ID NO: 828981 - protein, 612 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQGPGPVLTVLALLLASTLA

SEQ ID NO: 828982 - protein, 310 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQLNGPSSGRGSGGKWRRQPVLQARRPAR

SEQ ID NO: 828983 - protein, 73 aa, Homo sapiens
LSEADVRALGGLACDLPGRFVAESAEVLLPRLVSCPGPLDQDQQEAARAALQGGGPPYGYSEGVWNLEGSPGG

SEQ ID NO: 828984 - protein, 472 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 828985 - protein, 472 aa, Homo sapiens; identical to SEQ ID NO: 828984

SEQ ID NO: 828986 - protein, 472 aa, Homo sapiens; identical to SEQ ID NO: 828984

SEQ ID NO: 828987 - protein, 71 aa, Homo sapiens
HGPSLIKPKNRHNIVPLQILWLNETGTIGDEKANMFRSQVTGKINLLGLIEMILLSVGVVIVCFRGPLERH

SEQ ID NO: 828988 - protein, 472 aa, Homo sapiens; identical to SEQ ID NO: 828984

SEQ ID NO: 828989 - protein, 472 aa, Homo sapiens; identical to SEQ ID NO: 828984

SEQ ID NO: 828990 - protein, 472 aa, Homo sapiens; identical to SEQ ID NO: 828984

SEQ ID NO: 828991 - protein, 472 aa, Homo sapiens; identical to SEQ ID NO: 828984

SEQ ID NO: 828992 - protein, 472 aa, Homo sapiens; identical to SEQ ID NO: 828984

SEQ ID NO: 828993 - protein, 472 aa, Homo sapiens; identical to SEQ ID NO: 828984

SEQ ID NO: 828994 - protein, 472 aa, Homo sapiens; identical to SEQ ID NO: 828984

SEQ ID NO: 828995 - protein, 472 aa, Homo sapiens; identical to SEQ ID NO: 828984

SEQ ID NO: 828996 - protein, 472 aa, Homo sapiens; identical to SEQ ID NO: 828984

SEQ ID NO: 828997 - protein, 472 aa, Homo sapiens; identical to SEQ ID NO: 828984

SEQ ID NO: 828998 - protein, 472 aa, Homo sapiens; identical to SEQ ID NO: 828984

SEQ ID NO: 828999 - protein, 472 aa, Homo sapiens; identical to SEQ ID NO: 828984

SEQ ID NO: 829000 - protein, 396 aa, Homo sapiens
MMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 829001 - protein, 396 aa, Homo sapiens; identical to SEQ ID NO: 829000

SEQ ID NO: 829002 - protein, 317 aa, Homo sapiens
MILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 829003 - protein, 228 aa, Homo sapiens [sequence omitted]

SEQ ID NO: 829004 - protein, 431 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETATIGDEITPGQK

SEQ ID NO: 829005 - protein, 234 aa, Homo sapiens [sequence omitted]

SEQ ID NO: 829006 - protein, 227 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAVSRQTTKLSILKYSRTHVINPIIRIIRFYLFFHFYQNVFLYHYFEWRHGHLESDKIIRIDCIRRPLYFFHYFLSKHSLYLISIL

SEQ ID NO: 829007 - protein, 255 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRGVKKGILSLIWGKGPLAEHWI

SEQ ID NO: 829008 - protein, 227 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYTYCWSYKFHGKILSKCISPFKRI

SEQ ID NO: 829009 - protein, 1227 aa, Homo sapiens [sequence omitted]

SEQ ID NO: 829010 - protein, 196 aa, Homo sapiens
DVDYDGKRDRWNGYNPEEHIENVEEYAKVDLAKRTLKAQKLQEELALGKLVEQANSPKHQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEGGPPPSPCTGHLQGGQTASLKADPPYPVSTFDA

SEQ ID NO: 829011 - protein, 131 aa, Homo sapiens
MGSQDPNFEKGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 829012 - protein, 1271 aa, Homo sapiens [sequence omitted]

SEQ ID NO: 829013 - protein, 1064 aa, Homo sapiens
MQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 829014 - protein, 1294 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQGPRAGGCFGSTATSYPPPASTACVVAKPVWGWGTQRSPGGGPGSPSAVQAKA

SEQ ID NO: 829015 - protein, 1188 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKR

SEQ ID NO: 829016 - protein, 446 aa, Homo sapiens
MIRGAPGVMHSGTGLKLSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 829017 - protein, 932 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSKEAIR

SEQ ID NO: 829018 - protein, 378 aa, Homo sapiens
QGSRRCSEGRVCAVAPARSWPKPAQTAHLCGMEQNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 829019 - protein, 1076 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSRKAPGLSYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDK

SEQ ID NO: 829020 - protein, 303 aa, Homo sapiens
AVEAGSSRLAPPASQSSKAKHARVTIHPGHDAGPPLLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 829021 - protein, 131 aa, Homo sapiens; identical to SEQ ID NO: 829011

SEQ ID NO: 829022 - protein, 822 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEVSVAGDGLGPPILLSWGHAGPLDLRSGALPGPQQTLPSGIGEIGRTLSPVWKVSGCSLRGDPASTMPSRWQPSPCLTQPPLSFSVIVGCVQGPLFFYPPQSCQLRLPSQGDLCKGGE

SEQ ID NO: 829023 - protein, 649 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLESEFCMLRSV

SEQ ID NO: 829024 - protein, 113 aa, Homo sapiens
VRVRGTLLVPTSPRRIGWPLFISNQSEVAEPEAASEREPGWRREGPQEQNHHARESSFIGWNAVASQALSIPPQTKVSWHHQDRWGLHSGTWGLPIEMETPDLSLGTPERFRP

SEQ ID NO: 829025 - protein, 1271 aa, Homo sapiens [sequence omitted]

SEQ ID NO: 829026 - protein, 155 aa, Homo sapiens [sequence omitted]

SEQ ID NO: 829027 - protein, 1271 aa, Homo sapiens [sequence omitted]

SEQ ID NO: 829028 - protein, 1298 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVSECWPAQDGMEVWAMVSAMRSQSAPGPDNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 829029 - protein, 1370 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLGGGFRELSRAGWGRVTGLGSLFALKSQVSCQSLGAARHPWSGYQWKTECQTKLVLKLYLLCDLKIKVHMSGNLTVYCHTMHLTDGSPSHLCYLTCALFQPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 829030 - protein, 1135 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSKALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDK

SEQ ID NO: 829031 - protein, 1110 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDK

SEQ ID NO: 829032 - protein, 968 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSSRGEKGEQTESQVSRRSCRRRGCSCPEGSRITFKEVCGVPG

SEQ ID NO: 829033 - protein, 250 aa, Homo sapiens
MNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 829034 - protein, 330 aa, Homo sapiens
AVEAGSSRLAPPASQSSKAKHARVTIHPGHDAGPPLLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVSECWPAQDGMEVWAMVSAMRSQSAPGPDNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 829035 - protein, 931 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEGEDRMKASSTRKRLLLMEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDK

SEQ ID NO: 829036 - protein, 516 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSP

SEQ ID NO: 829037 - protein, 122 aa, Homo sapiens
DCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDAGEFLTPRAWAHLHGGGKP

SEQ ID NO: 829038 - protein, 456 aa, Homo sapiens
PEAAAAPCAGAEPGAGRRPAGGGWGPRPGVPERRRRRRQRRPSGLGGWVRGGSGSARGLRCERAARLPSSPARRRRCDWVEDGAGRMEILMTVSKFASICTMGANASALEKEIGPEQFPVNEHYFGLVNFGNTCYCNSVLQALYFCRPFREKVLAYKSQPRKKESLLTCLADLFHSIATQKKKVGVIPPKKFITRLRKENELFDNYMQQDAHEFLNYLLNTIADILQEERKQEKQNGRLPNGNIDNENNNSTPDPTWVHEIFQGTLTNETRCLTCETISSKDEDFLDLSVDVEQNTSITHCLRGFSNTETLCSEYKYYCEECRSKQEAHKRMKVKKLPMILALHLKRFKYMDQLHRYTKLSYRVVFPLELRLFNTSGDATNPDRMYDLVAVVVHCGSGPNRGHYIAIVKSHDFWLLFDDDIVEKIDAQAIEEFYGLTSDISKNSESGYILFYQSRD

SEQ ID NO: 829039 - protein, 250 aa, Homo sapiens
MQQDAHEFLNYLLNTIADILQEERKQEKQNGRLPNGNIDNENNNSTPDPTWVHEIFQGTLTNETRCLTCETISSKDEDFLDLSVDVEQNTSITHCLRGFSNTETLCSEYKYYCEECRSKQEAHKRMKVKKLPMILALHLKRFKYMDQLHRYTKLSYRVVFPLELRLFNTSGDATNPDRMYDLVAVVVHCGSGPNRGHYIAIVKSHDFWLLFDDDIVEKIDAQAIEEFYGLTSDISKNSESGYILFYQSRD

SEQ ID NO: 829040 - protein, 116 aa, Homo sapiens
GLVIGGVECAEAGIGPEAVEMARVVFPLELRLFNTSGDATNPDRMYDLVAVVVHCGSGPNRGHYIAIVKSHDFWLLFDDDIVEKIDAQAIEEFYGLTSDISKNSESGYILFYQSRD

SEQ ID NO: 829041 - protein, 418 aa, Homo sapiens
PEAAAAPCAGAEPGAGRRPAGGGWGPRPGVPERRRRRRQRRPSGLGGWVRGGSGSARGLRCERAARLPSSPARRRRCDWVEDGAGRMEILMTVSKFASICTMGANASALEKEIGPEQFPVNEHYFGLVNFGNTCYCNSVLQALYFCRPFREKVLAYKSQPRKKESLLTCLADLFHSIATQKKKVGVIPPKKFITRLRKENELFDNYMQQDAHEFLNYLLNTIADILQEERKQEKQNGRLPNGNIDNENNNSTPDPTWVHEIFQGTLTNETRCLTCETISSKDEDFLDLSVDVEQNTSITHCLRGFSNTETLCSEYKYYCEECRSKQEAHKRMKVKKLPMILALHLKRFKYMDQLHRYTKLSYRVVFPLELRLFNTSGDATNPDRMYDLVAVVVHCGREYHFKVQWRRTPRAPKWKDDL

SEQ ID NO: 829042 - protein, 89 aa, Homo sapiens
RRQRLRPAPGRSRGRAGGRQAGAGARGRECLSAGGDDGSGGPAGSVVGSAAARGPPAGCGASGRPGSPPPPPAAAAVIGWKMALAGWKS

SEQ ID NO: 829043 - protein, 251 aa, Homo sapiens
DAWVDPRVRLNYLLNTIADILQEERKQEKQNGRLPNGNIDNENNNSTPDPTWVHEIFQGTLTNETRCLTCETISSKDEDFLDLSVDVEQNTSITHCLRGFSNTETLCSEYKYYCEECRSKQEAHKRMKVKKLPMILALHLKRFKYMDQLHRYTKLSYRVVFPLELRLFNTSGDATNPDRMYDLVAVVVHCGSGPNRGHYIAIVKSHDFWLLFDDDIVEKIDAQAIEEFYGLTSDISKNSESGYILFYQSRD

SEQ ID NO: 829044 - protein, 67 aa, Homo sapiens
EDPKSLMAGPNRGHYIAIVKSHDFWLLFDDDIVEKIDAQAIEEFYGLTSDISKNSESGYILFYQSRD

SEQ ID NO: 829045 - protein, 203 aa, Homo sapiens
KLHTGEKPYECKECGKAFRVRQQLTLHQRIHTGEKPYECKECGKTFSRGYHLILHHRIHTGEKPYECKECWKAFSRYSQLISHQSIHIGVKPYDCKECGKAFRLLSQLTQHQSIHIGEKPYKCKECGKAFRLRQKLTLHQSIHTGEKPFECKECRKAFRLNSSLIQHLRIHSGEKPYECKECKKAFRQHSHLTHHLKIHNVKI

SEQ ID NO: 829046 - protein, 203 aa, Homo sapiens; identical to SEQ ID NO: 829045

SEQ ID NO: 829047 - protein, 717 aa, Homo sapiens
MSVDKAELCGSLLTWLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829048 - protein, 136 aa, Homo sapiens
ICLALALIPAFGLSSVVHECFFSSMVWKRHGQTWRWYQGGIGWYSPDTTQLTAAARRIEELQHNLQKKDADLRAMEERYRRYVDKARMVMQTMEPKQRPAAGAPPELHSLRTQLRERDVRIRHLEMDFEKTPVTEQ

SEQ ID NO: 829049 - protein, 644 aa, Homo sapiens
MVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829050 - protein, 733 aa, Homo sapiens
MRVSAHLVTDVPRSVSLCQPSGPEQRPCRSLCAEPDVSGAEGEDPKSVPQSAHPTFSPPGDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829051 - protein, 740 aa, Homo sapiens
PALVPFPHYPLHPLPGAGVWKTTREEVVGIWTSIRGPRLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829052 - protein, 606 aa, Homo sapiens
RRIPFFLGPVLSVAKKSRHHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829053 - protein, 362 aa, Homo sapiens
MAHLGKKPVQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829054 - protein, 717 aa, Homo sapiens; identical to SEQ ID NO: 829047

SEQ ID NO: 829055 - protein, 655 aa, Homo sapiens
MSVDKAELCGSLLTWLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKTPVTEQ

SEQ ID NO: 829056 - protein, 465 aa, Homo sapiens
MSVDKAELCGSLLTWLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPHGSTHTGDTSAKPAAEQVDARARGTTWRE

SEQ ID NO: 829057 - protein, 202 aa, Homo sapiens
PALVPFPHYPLHPLPGAGVWKTTREEVVGIWTSIRGPRVRTAAHEWAVIGCLGLQTFHVPSPCASPQDLSSGLAVAYVLNQIDPSWFNEAWLQGISEDPGPNWKLKVTSGLLIRGQTGEEMTRDGPARHMSWVMGRKRDRCLVINHLFIHSSMEYSPCARPGHSARNNTDKNLPHTAIILVTSNTYTTIKINFQAGRSGSCL

SEQ ID NO: 829058 - protein, 202 aa, Homo sapiens; identical to SEQ ID NO: 829057

SEQ ID NO: 829059 - protein, 68 aa, Homo sapiens
QQRGADGPPLPPAARRIEELQHNLQKKDADLRAMEERYRRYVDKARMVRTLGVPTSCLPWLLTFCASY

SEQ ID NO: 829060 - protein, 124 aa, Homo sapiens [sequence omitted]

SEQ ID NO: 829061 - protein, 755 aa, Homo sapiens
PALVPFPHYPLHPLPGAGVWKTTREEVVGIWTSIRGPRVRTAAHEWAVIGCLGLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829062 - protein, 644 aa, Homo sapiens; identical to SEQ ID NO: 829049

SEQ ID NO: 829063 - protein, 759 aa, Homo sapiens
PALVPFPHYPLHPLPGAGVWKTTREEVVGIWTSIRGPRLQTFHVPSPCASPQDLSSGLAVAYVLNQIDPSWFNEAWLQGISEDPGPNWKLKVTSGLLIRGQTGQQSEDGLTEPSRVLPGCPGASCVRRASPRCEPHWRVLRPGRARQAASAGAGLCHQLREKAGLPHLDPQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829064 - protein, 295 aa, Homo sapiens
MVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQPCRSSGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829065 - protein, 267 aa, Homo sapiens
GRWWLNQLGSCGMGRSGQQGLFRGIPAKGAEGCGSDSCGAGGTRAHSPRHEGQAERALWPCRGISGWRGGLWLPLGQKRSQPGGQPTAAHPRPTGQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829066 - protein, 169 aa, Homo sapiens
DLVTRGWGDPRAQQRGADGPPLPPAARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 829067 - protein, 202 aa, Homo sapiens; identical to SEQ ID NO: 829057

SEQ ID NO: 829068 - protein, 128 aa, Homo sapiens
MVLRSLVEYSQDVLAHPVSEEHLPDVSLIGEFSDPAELGKLLQLVLGCAISCEKKQASPTLTPDHIQRIMTLEESVQHVVMEAIQELMTKDTPDSLSPETYGNFDSQMESHSVTQAGVQWHDLGSLQP

SEQ ID NO: 829069 - protein, 1007 aa, Homo sapiens
GFVDSRLLRRIRQSCKGVEGMCVSFQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKSESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDSYISKVDVLNILVAAAYRHVPSLDQILQPAAVTRLRNQLLEAEYYQLGVEVSTKTGLDTTGAWHAWGMACLKAGNLTAAREKFSRCLKPPFDLNQLNHGSRLVQDVVEYLESTVRPFVSLQDDDYFATLRELEATLRTQSLSLAVIPEGKIMNNTYYQECLFYLHNYSTNLAIISFYVRHSCLREALLHLLNKESPPEVFIEGIFQPSYKSGKLHTLENLLESIDPTLESWGKYLIAACQHLQKKNYYHILYELQQFMKDQVRAAMTCIRFFSHKAKSYTELGEKLSWLLKAKDHLKIYLQETSRSSGRKKTTFFRKKMTAADVSRHMNTLQLQMEVTRFLHRCESAGTSQITTLPLPTLFGNNHMKMDVACKVMLGGKNVEDGFGIAFRVLQDFQLDAAMTYCRAARQLVEKEKYSEIQQLLKCVSESGMAAKSDGDTILLNCLEAFKRIPPQELEGLIQAIHNDDNKVRAYLICCKLRSAYLIAVKQEHSRATALVQQVQQAAKSSGDAVVQDICAQWLLTSHPRGAHGPGSRK

SEQ ID NO: 829070 - protein, 362 aa, Homo sapiens
SGQHGVPPWREALLHLLNKESPPEVFIEGIFQPSYKSGKLHTLENLLESIDPTLESWGKYLIAACQHLQKKNYYHILYELQQFMKDQVRAAMTCIRFFSHKAKSYTELGEKLSWLLKAKDHLKIYLQETSRSSGRKKTTFFRKKMTAADVSRHMNTLQLQMEVTRFLHRCESAGTSQITTLPLPTLFGNNHMKMDVACKVMLGGKNVEDGFGIAFRVLQDFQLDAAMTYCRAARQLVEKEKYSEIQQLLKCVSESGMAAKSDGDTILLNCLEAFKRIPPQELEGLIQAIHNDDNKVRAYLICCKLRSAYLIAVKQEHSRATALVQQVQQAAKSSGDAVVQDICAQWLLTSHPRGAHGPGSRK

SEQ ID NO: 829071 - protein, 1228 aa, Homo sapiens
RLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACDKEGWQYLFPVKDASLRSRLALQFVDRWPLESCLEILAYCISDTAVQEGLKCELQRKLAELQVYQKILGLQSPPVWCDWQTLRSCCVEDPSTVMNMILEAQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKSESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDSYISKVDVLNILVAAAYRHVPSLDQILQPAAVTRLRNQLLEAEYYQLGVEVSTKTGLDTTGAWHAWGMACLKAGNLTAAREKFSRCLKPPFDLNQLNHGSRLVQDVVEYLESTVRPFVSLQDDDYFATLRELEATLRTQSLSLAVIPEGKIMNNTYYQECLFYLHNYSTNLAIISFYVRHSCLREALLHLLNKVGHGHSSKRQCLPYSSGLDHSALSGTITP

SEQ ID NO: 829072 - protein, 1007 aa, Homo sapiens
RLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACDKEGWQYLFPVKDASLRSRLALQFVDRWPLESCLEILAYCISDTAVQEGLKCELQRKLAELQVYQKILGLQSPPVWCDWQTLRSCCVEDPSTVMNMILEAQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKSESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDR

SEQ ID NO: 829073 - protein, 1542 aa, Homo sapiens
RLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACDKEGWQYLFPVKDASLRSRLALQFVDRWPLESCLEILAYCISDTAVQEGLKCELQRKLAELQVYQKILGLQSPPVWCDWQTLRSCCVEDPSTVMNMILEAQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKSESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDSYISKVDVLNILVAAAYRHVPSLDQILQPAAVTRLRNQLLEAEYYQLGVEVSTKTGLDTTGAWHAWGMACLKAGNLTAAREKFSRCLKPPFDLNQLNHGSRLVQDVVEYLESTVRPFVSLQDDDYFATLRELEATLRTQSLSLAVIPEGKIMNNTYYQECLFYLHNYSTNLAIISFYVRHSCLREALLHLLNKESPPEVFIEGIFQPSYKSGKLHTLENLLESIDPTLESWGKYLIAACQHLQKKNYYHILYELQQFMKDQVRAAMTCIRFFSHKAKSYTELGEKLSWLLKAKDHLKIYLQETSRSSGRKKTTFFRKKMTAADVSRHMNTLQLQMEVTRFLHRCESAGTSQITTLPLPTLFGNNHMKMDVACKVMLGGKNVEDGFGIAFRVLQDFQLDAAMTYCRAARQLVEKEKYSEIQQLLKCVSESGMAAKSDGDTILLNCLEAFKRIPPQELEGLIQAIHNDDNKVRAYLICCKLRSAYLIAVKQEHSRATALVQQVQQAAKSSGDAVVQDICAQWLLTSHPRGAHGPGSRK

SEQ ID NO: 829074 - protein, 1484 aa, Homo sapiens
RLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACDKEGWQYLFPVKDASLRSRLALQFVDRWPLESCLEILAYCISDTAVQEGLKCELQRKLAELQVYQKILGLQSPPVWCDWQTLRSCCVEDPSTVMNMILEAQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKSESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDSYISKVDVLNILVAAAYRHVPSLDQILQPAAVTRLRNQLLEAEYYQLGVEVSTKTGLDTTGAWHAWGMACLKAGNLTAAREKFSRCLKPPFDLNQLNHGSRLVQDVVEYLESTVRPFVSLQDDDYFATLRELEATLRTQSLSLAVIPEGKIMNNTYYQECLFYLHNYSTNLAIISFYVRHSCLREALLHLLNKESPPEVFIEGIFQPSYKSGKLHTLENLLESIDPTLESWGKYLIAACQHLQKKNYYHILYELQQFMKDQVRAAMTCIRFFSHKAKSYTELGEKLSWLLKAKDHLKIYLQETSRSSGRKKTTFFRKKMTAADVSRHMNTLQLQMEVTRFLHRCESAGTSQITTLPLPTLFGNNHMKMDVACKVMLGGKNVEDGFGIAFRVLQDFQLDAAMTYCRAARQLVEKEKYSEIQQLLKCVSESGMAAKSDGDTILLNCLEAFKRIPPQELEGLIQAIHNDDNKVSGIVSKRW

SEQ ID NO: 829075 - protein, 1167 aa, Homo sapiens
RLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACDKEGWQYLFPVKDASLRSRLALQFVDRWPLESCLEILAYCISDTAVQEGLKCELQRKLAELQVYQKILGLQSPPVWCDWQTLRSCCVEDPSTVMNMILEAQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKSESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDSYISKVDVLNILVAAAYRHVPSLDQILQPAAVTRLRNQLLEAEYYQLGVEVSTKTGLDTTGAWHAWGMACLKAGNLTAAREKFSRCLKPPFDLNQLNHGSRLVQDVVEYLESTVRPFVSLVRARQEECLAQGGRPRNSNDLGKESVEIQLTVSVLAQHQAG

SEQ ID NO: 829076 - protein, 501 aa, Homo sapiens
RLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACGEQNAMPPFFTSGNIWYSLGILSHLILTVTLERSPTIISCY

SEQ ID NO: 829077 - protein, 112 aa, Homo sapiens
AGVGAARLRRRRAPSGTLNGPYAQDKHGLNQVHAPAGDALTEVRTAVPGQVKPRTLGPKNLTGTPCLMKLRTARCASSESETKFRHVAQADLKLLGSSNPPALASRSAGITG

SEQ ID NO: 829078 - protein, 81 aa, Homo sapiens
AGVGAARLRRRRAPSGTLNGPYAQDKHGLNQVHAPAGDALTEVRTAVPGQVKPRTLGPKNLTGTPCLMKLRTARCASSESG

SEQ ID NO: 829079 - protein, 119 aa, Homo sapiens
AGVGAARLRRRRAPSGTLNGPYAQDKHGLNQVHAPAGDALTEVRTAVPGQVKPRTLGPKNLTGTPCLMKLRTARCASSESDHHYEEQNRPLAHLDRAGKWQSQDHPDGSASKPASLIAM

SEQ ID NO: 829080 - protein, 112 aa, Homo sapiens; identical to SEQ ID NO: 829077

SEQ ID NO: 829081 - protein, 582 aa, Homo sapiens
MASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 829082 - protein, 494 aa, Homo sapiens
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAAVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 829083 - protein, 280 aa, Homo sapiens
PFPIHSIAEWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 829084 - protein, 577 aa, Homo sapiens
MASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLQDVLERLSPEWPRLDPVAPSGVG

SEQ ID NO: 829085 - protein, 246 aa, Homo sapiens
MASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIAGQYPAWPQLY

SEQ ID NO: 829086 - protein, 582 aa, Homo sapiens; identical to SEQ ID NO: 829081

SEQ ID NO: 829087 - protein, 354 aa, Homo sapiens
MTHSLPFADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 829088 - protein, 228 aa, Homo sapiens
MASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSPRDSL

SEQ ID NO: 829089 - protein, 84 aa, Homo sapiens
SSLRQVVNVYADGKEVEDRQSAPYRGRTSILRDGITAGKAALRIHNVTASDSGKYLCYFQDGDFYEKALVELKVAVQVSLQVLF

SEQ ID NO: 829090 - protein, 371 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSSDGAFGGCV

SEQ ID NO: 829091 - protein, 371 aa, Homo sapiens; identical to SEQ ID NO: 829090

SEQ ID NO: 829092 - protein, 683 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 829093 - protein, 683 aa, Homo sapiens; identical to SEQ ID NO: 829092

SEQ ID NO: 829094 - protein, 683 aa, Homo sapiens; identical to SEQ ID NO: 829092

SEQ ID NO: 829095 - protein, 740 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 829096 - protein, 510 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 829097 - protein, 365 aa, Homo sapiens
MFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 829098 - protein, 567 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 829099 - protein, 724 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQLHVSTETRLEHPCPVSETKWRVLFWGFVFFGGFLSLALQIYFWGLF

SEQ ID NO: 829100 - protein, 237 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENV

SEQ ID NO: 829101 - protein, 121 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDP

SEQ ID NO: 829102 - protein, 683 aa, Homo sapiens; identical to SEQ ID NO: 829092

SEQ ID NO: 829103 - protein, 391 aa, Homo sapiens
MFPDQPEKPLNLAHIVPPRPVTSMNDTLFSHSVPSSGSPFITRSSPPKDSEVEQNKLLARAAPAFLKGKGMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 829104 - protein, 567 aa, Homo sapiens; identical to SEQ ID NO: 829098

SEQ ID NO: 829105 - protein, 567 aa, Homo sapiens; identical to SEQ ID NO: 829098

SEQ ID NO: 829106 - protein, 192 aa, Homo sapiens
MFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 829107 - protein, 740 aa, Homo sapiens; identical to SEQ ID NO: 829095

SEQ ID NO: 829108 - protein, 740 aa, Homo sapiens; identical to SEQ ID NO: 829095

SEQ ID NO: 829109 - protein, 735 aa, Homo sapiens [sequence omitted]

SEQ ID NO: 829110 - protein, 160 aa, Homo sapiens
MFAFSECILHKTLSNKCHSPFQECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGTWPPQARHQERHWQTWAVGLGACALFWLAPTPGGRCPHSIRC

SEQ ID NO: 829111 - protein, 144 aa, Homo sapiens
MVCGCSWLPCPAQAEQELRVAQTEFDRQAEVTRLLLEGISSTHVNHLLLPPQRERLETNIPLQQGGRILCRGTHVYLGDDMPDPGLVLAGTKCADGKICLNRQCQNISVFGVHECAMQCHGRGCVQQQEELHCEGGWTSLTLDF

SEQ ID NO: 829112 - protein, 906 aa, Homo sapiens [sequence omitted]

SEQ ID NO: 829113 - protein, 906 aa, Homo sapiens [sequence omitted]

SEQ ID NO: 829114 - protein, 906 aa, Homo sapiens [sequence omitted]

SEQ ID NO: 829115 - protein, 735 aa, Homo sapiens [sequence omitted]

SEQ ID NO: 829116 - protein, 552 aa, Homo sapiens
MNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 829117 - protein, 735 aa, Homo sapiens [sequence omitted]

SEQ ID NO: 829118 - protein, 728 aa, Homo sapiens
LSPYQNSTVRECVSTILSDMVLKHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 829119 - protein, 778 aa, Homo sapiens
MAARPLPVSPARALLLALAGALLAPCEARGVSLWNQGRADEVVSASVRSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRYPGFSLSSVLEMVAQRLGAVAQACNPSTLGG

SEQ ID NO: 829120 - protein, 575 aa, Homo sapiens
MDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 829121 - protein, 463 aa, Homo sapiens
MNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 829122 - protein, 487 aa, Homo sapiens [sequence omitted]

SEQ ID NO: 829123 - protein, 351 aa, Homo sapiens
MTPGYCGKLKTPCQCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 829124 - protein, 471 aa, Homo sapiens [sequence omitted]

SEQ ID NO: 829125 - protein, 105 aa, Homo sapiens
MSISIVFVLPNFEYGLHSKLFTTTNTLCNAVPGRGVCNNRKNCHCEAHWAPPFCDKFGFGGSTDSGPIRQAEARQEAAESNRERGQGQEPVGSQEHASTASLTLI

SEQ ID NO: 829126 - protein, 242 aa, Homo sapiens
MAARPLPVSPARALLLALAGALLAPCEARGVSLWNQGRADEVVSASVRSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARREGEELSHLVLWLTLTWLLGGRTLYPNPKEQSLKITPPTSTL

SEQ ID NO: 829127 - protein, 122 aa, Homo sapiens
MNSRVWNDFVSSHLLHMPPAAATSLLQSRPPLLTSPSPQSPPPPPPPNIITISLMTIITISLPLPPPSSLQPSPSPHYCNHCHLHSYCHHRGHTSIHIATSITATIPTPIIIPTTTITSANA

SEQ ID NO: 829128 - protein, 122 aa, Homo sapiens; identical to SEQ ID NO: 829127

SEQ ID NO: 829129 - protein, 129 aa, Homo sapiens
MAARPLPVSPARALLLALAGALLAPCEARGVSLWNQGRADEVVSASVRSGDLWIPVKSFDSKNHPEVLNIRLQRESKELIINLERNEGLIASSFTETHYLQDGTDVSLARNYTVLYYMNGNLLHHYTVC

SEQ ID NO: 829130 - protein, 134 aa, Homo sapiens [sequence omitted]

SEQ ID NO: 829131 - protein, 70 aa, Homo sapiens
SVYLVSETRGRQPRFQRQGKDLEKVKQRLIEIANHVDKFYRPLNIRIVLVGLGMSVKFSLSSKGDSEMNQ

SEQ ID NO: 829132 - protein, 778 aa, Homo sapiens; identical to SEQ ID NO: 829119

SEQ ID NO: 829133 - protein, 735 aa, Homo sapiens [sequence omitted]

SEQ ID NO: 829134 - protein, 735 aa, Homo sapiens [sequence omitted]

SEQ ID NO: 829135 - protein, 724 aa, Homo sapiens
APLLSTPLFSYLWKKRRKYHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 829136 - protein, 640 aa, Homo sapiens
MDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 829137 - protein, 519 aa, Homo sapiens
MTKPCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 829138 - protein, 487 aa, Homo sapiens [sequence omitted]

SEQ ID NO: 829139 - protein, 478 aa, Homo sapiens
MATSLNCNGPISRLPGGPGVLAVDLPIPAGHRATEAGPLGEEELKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 829140 - protein, 433 aa, Homo sapiens
MAARPLPVSPARALLLALAGALLAPCEARGVSLWNQGRADEVVSASVRSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCAWVRTQAHF

SEQ ID NO: 829141 - protein, 340 aa, Homo sapiens
MAARPLPVSPARALLLALAGALLAPCEARGVSLWNQGRADEVVSASVRSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSQWSRAAPMGICLNGPCTIPP

SEQ ID NO: 829142 - protein, 127 aa, Homo sapiens
MNSRVWNDFVSSHLLHMPPAAATSLLQSRPPLLTSPSPQSPPPPPPPNIITISLMTIITISLPLPPPSSLQPSPSPHYCNHCHLHSYCHHRGHTSIHIATSITATIPTPIIIPTTTPSVERDPLDLT

SEQ ID NO: 829143 - protein, 191 aa, Homo sapiens
INVRHVGKAFILPRHFKDMKKLTLQRNPMNASNVVKPSVVPVPFGTMKGLTLERNPMSVSNVGKPSDLPQSFKCMLGLTLKRSPTSVSNVGKPSDLPHTFESMGRTHTGEKPYECKECGKAFRSAKNLRIHERTQTHVRMHSVERPYKCKICGKGFYSAKSFQIHEKSYTGEKPYECKQCGKAFISFTSFR

SEQ ID NO: 829144 - protein, 100 aa, Homo sapiens
MKDEEKMEIQEMQLKEAKHIAEEADRKYEEVSGAEQMAQQQEVGGNASAEIGRTPGPTEGSSRLGQLSSCVNICLSRDNHLAEETISHDASKCCGRLSNV

SEQ ID NO: 829145 - protein, 333 aa, Homo sapiens
RTFQQLWPAVPTSGPPPAVLTSAVRPGDLIAPTAAGPGGGERRGKPPHRQRLGGPGRGCAALAGAEPSRASAAARAPLRLRAMAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAERAEVSELKCGDLEEELKNVTNHLKSLEAASEKYSEKEDKYEEEIKLLSDKLKEAETRAEFAERTVAKLEKTIDDLEEKLAQAKEENVGLHQTLDQTLNELNCI

SEQ ID NO: 829146 - protein, 291 aa, Homo sapiens
MTCGLLDMADLNWTELHHIPAEWVITGMRHLLFREQLYFYFFLRWSLTLSTRLERCGTISAHCSLRSWVQVILLPQPPEHVELQAEGDVAALNRRIQLVEEELDRAQERLATALQKLEEAEKAADESERGMKVIENRAMKDEEKMEIQEMQLKEAKHIAEEADRKYEEVARKLVILEGELERAEERAERAEVSELKCGDLEEELKNVTNHLKSLEAASEKYSEKEDKYEEEIKLLSDKLKEAETRAEFAERTVAKLEKTIDDLEEKLAQAKEENVGLHQTLDQTLNELNCI

SEQ ID NO: 829147 - protein, 271 aa, Homo sapiens
MFFPDIFREDHTEIWYECKFTYGLDSWVGFDREDQVNRGQDMGEAPTGGWPDDFLTWLHLRPPQAEGDVAALNRRIQLVEEELDRAQERLATALQKLEEAEKAADESERGMKVIENRAMKDEEKMEIQEMQLKEAKHIAEEADRKYEEVARKLVILEGELERAEERAERAEVSELKCGDLEEELKNVTNHLKSLEAASEKYSEKEDKYEEEIKLLSDKLKEAETRAEFAERTVAKLEKTIDDLEEKLAQAKEENVGLHQTLDQTLNELNCI

SEQ ID NO: 829148 - protein, 100 aa, Homo sapiens
APPRLRASAPPRHLNSLEAVKRKIQALQQQADEAEDRAQGLQRELDGERERREKAEGDVAALNRRIQLVEEELDRAQERLATALQKLEEAEKAADESESI

SEQ ID NO: 829149 - protein, 336 aa, Homo sapiens
SAPQPQPLTAAAPTEPAAHPTSPRQRPAMEAIKKKMQMLKLDKENAIDRAEQAEADKKAAEDKCKQVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAERAEVSELKCGDLEEELKNVTNHLKSLEAASEKYSEKEDKYEEEIKLLSDKLKEAETRAEFAERTVAKLEKTIDDLVSYTLQKLKYKAISEELDHALNDMTSPERQPGRCPLSFSHGASYGPVAF

SEQ ID NO: 829150 - protein, 315 aa, Homo sapiens
SAPQPQPLTAAAPTEPAAHPTSPRQRPAMEAIKKKMQMLKLDKENAIDRAEQAEADKKAAEDKCKQVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAERAEVSELKCGDLEEELKNVTNHLKSLEAASEKYSEKEDKYEEEIKLLSDKLKEAETRAEFAERTVAKLEKTIDDLEEKLAQAKEENVGLHQTLDQTLNELNCI

SEQ ID NO: 829151 - protein, 221 aa, Homo sapiens
MILLPQPPEHVELQAEGDVAALNRRIQLVEEELDRAQERLATALQKLEEAEKAADESERGMKVIENRAMKDEEKMEIQEMQLKEAKHIAEEADRKYEEVARKLVILEGELERAEERAERAEVSELKCGDLEEELKNVTNHLKSLEAASEKYSEKEDKYEEEIKLLSDKLKEAETRAEFAERTVAKLEKTIDDLEEKLAQAKEENVGLHQTLDQTLNELNCI

SEQ ID NO: 829152 - protein, 271 aa, Homo sapiens
SAPQPQPLTAAAPTEPAAHPTSPRQRPAMEAIKKKMQMLKLDKENAIDRAEQAEADKKAAEDKCKQVEEELTHLQKKLKGTEDELDKYSEDLKDAQEKLELYGEEGLRRGMKVIENRAMKDEEKMEIQEMQLKEAKHIAEEADRKYEEVARKLVILEGELERAEERAERAEVSELKCGDLEEELKNVTNHLKSLEAASEKYSEKEDKYEEEIKLLSDKLKEAETRAEFAERTVAKLEKTIDDLEEKLAQAKEENVGLHQTLDQTLNELNCI

SEQ ID NO: 829153 - protein, 315 aa, Homo sapiens; identical to SEQ ID NO: 829150

SEQ ID NO: 829154 - protein, 266 aa, Homo sapiens
SAPQPQPLTAAAPTEPAAHPTSPRQRPAMEAIKKKMQMLKLDKENAIDRAEQAEADKKAAEDKCKQVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERARCLNCEWQNRTERGWLDSWGGVGRSWLCWELALTGVSAQVDGRQGLMAHLFSWLL

SEQ ID NO: 829155 - protein, 477 aa, Homo sapiens
MTSKFLLVSFILAALSLSTTFSLQPDQQKVLLVSFDGFRWDYLYKVPTPHFHYIMKYGVHVKQVTNVFITKTYPNHYTLVTGLFAENHGIVANDMFDPIRNKSFSLDHMNIYDSKFWEEATPIWITNQRAGHTSGAAMWPGTDVKIHKRFPTHYMPYNESVSFEDRVAKIIEWFTSKEPINLGLLYWEDPDDMGHHLGPDSPLMGPVISDIDKKLGYLIQMLKKAKLWNTLNLIITSDHGMTQCSEERLIELDQYLDKDHYTLIDQSPVAAILPKEGKFDEVYEALTHAHPNLTVYKKEDVPERWHYKYNSRIQPIIAVADEGWHILQNKSDDFLLGNHGYDNALADMHPIFLAHGPAFRKNFSKEAMNSTDLYPLLCHLLNITAMPHNGSFWNVQDLLNSAMPRVVPYTQSTILLPGSVKPAEYDQEGSYPYFIGVSLGSIIVIVFFVIFIKHLIHSQIPALQDMHAEIAQPLLQA

SEQ ID NO: 829156 - protein, 358 aa, Homo sapiens [sequence omitted]

SEQ ID NO: 829157 - protein, 477 aa, Homo sapiens; identical to SEQ ID NO: 829155

SEQ ID NO: 829158 - protein, 357 aa, Homo sapiens
MPILTGGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 829159 - protein, 617 aa, Homo sapiens
AKMELVRRLMPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEILGPHSLAYEIDKQCKFDFLAIYDGPSTNSGLIGQVCGRVTPTFRNWSSNSLTVGVVLQIMPILTGGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 829160 - protein, 155 aa, Homo sapiens
MHPFQWCNGCFCGLGLVSTNKSCSMPPISFQDLPLNIYMVIFGTGIFVFMLSLIFCCYFISKLRNQAQSERYGYKEVVLKGDAKKLQLYGQTCAVCLEDFKGKDELGVLPCQHAFHRKCLVKWLEVRCVCPMCNKPIASPSEATQNIGILLDELV

SEQ ID NO: 829161 - protein, 380 aa, Homo sapiens
MDDATVLRKKGYIVGINLGKGSYAKVKSAYSERLKFNVAVKIIDRKKTPTDFVERFLPREMDILATVNHGSIIKTYEIFETSDGRIYIIMELGVQGDLLEFIKCQGALHEDVARKMFRQLSSAVKYCHDLDIVHRDLKCENLLLDKDFNIKLSDFGFSKRCLRDSNGRIILSKTFCGSAAYAAPEVLQSIPYQPKVYDIWSLGVILYIMVCGSMPYDDSDIRKMLRIQKEHRVDFPRSKNLTCECKDLIYRMLQPDVSQRLHIDEILSHSWLQPPKPKATSSASFKREGEGKYRAECKLDTKTGLRPDHRPDHKLGAKTQHIPHIGQNEIESLGAHPSAAQQQYFPRLGEGCVGNERPVPMDEVKEMAMVFSQVEGETGQ

SEQ ID NO: 829162 - protein, 358 aa, Homo sapiens
MDDATVLRKKGYIVGINLGKGSYAKVKSAYSERLKFNVAVKIIDRKKTPTDFVERFLPREMDILATVNHGSIIKTYEIFETSDGRIYIIMELGVQGDLLEFIKCQGALHEDVARKMFRQLSSAVKYCHDLDIVHRDLKCENLLLDKDFNIKLSDFGFSKRCLRDSNGRIILSKTFCGSAAYAAPEVLQSIPYQPKVYDIWSLGVILYIMVCGSMPYDDSDIRKMLRIQKEHRVDFPRSKNLTCECKDLIYRMLQPDVSQRLHIDEILSHSWLQPPKPKATSSASFKREGEGKYRAECKLDTKTGLRPDHRPDHKLGAKTQHRLLVVPENENRMEDRLAETSRAKDHHISGAEVGKAST

SEQ ID NO: 829163 - protein, 203 aa, Homo sapiens [sequence omitted]

SEQ ID NO: 829164 - protein, 237 aa, Homo sapiens
VASPPGLQSPASHSAPGRVQPPAASSLPPLPASTQPKAPKGKSAGREKKVIHPYSRKAAQITREAHKQEKKEKLKNEKALRLNLVGEKLQWFQNHLDPPKKRYSKKDACELIERYLNRFSSELEQIELHNSIRDRQGRRHCSRETVIKQTMERERQQFEGYGLEIPDILNASNLKTFREWDFDLKKLPNIKMRKICANDAIPKTCKRKTTITVDQDLGELELNDESSDSDEEMTAVA

SEQ ID NO: 829165 - protein, 214 aa, Homo sapiens
MVGPLLLPPNRSPKAPKGKSAGREKKVIHPYSRKAAQITREAHKQEKKEKLKNEKALRLNLVGEKLQWFQNHLDPPKKRYSKKDACELIERYLNRFSSELEQIELHNSIRDRQGRRHCSRETVIKQTMERERQQFEGYGLEIPDILNASNLKTFREWDFDLKKLPNIKMRKICANDAIPKTCKRKTTITVDQDLGELELNDESSDSDEEMTAVA

SEQ ID NO: 829166 - protein, 185 aa, Homo sapiens
MPKAPKGKSAGREKKVIHPYSRKAAQITREAHKQEKKEKLKNEKALRLNLVGEKLQWFQNHLDPPKKRYSKKDACELIERYLNRFSSELEQIELHNSIRDRQGRRHCSRETVIKQTMERERQQFEGYGLEIPDILNASNLKTFREWDFDLKKLPNIKMRKICANDAIPKTCKRSSDSDEEMTAVA

SEQ ID NO: 829167 - protein, 203 aa, Homo sapiens [sequence omitted]

SEQ ID NO: 829168 - protein, 203 aa, Homo sapiens [sequence omitted]

SEQ ID NO: 829169 - protein, 230 aa, Homo sapiens
LVDSRWIPVLTETFVNLSCSVATRTSPLPKAPKGKSAGREKKVIHPYSRKAAQITREAHKQEKKEKLKNEKALRLNLVGEKLQWFQNHLDPPKKRYSKKDACELIERYLNRFSSELEQIELHNSIRDRQGRRHCSRETVIKQTMERERQQFEGYGLEIPDILNASNLKTFREWDFDLKKLPNIKMRKICANDAIPKTCKRKTTITVDQDLGELELNDESSDSDEEMTAVA

SEQ ID NO: 829170 - protein, 128 aa, Homo sapiens
SATRLNRSGVLENSRMKGKRGREELGNTQSAFFSTFGDAKPRVQLLGEARSPPPAAALLDMDPETCPCPSGGSCTCADSCKCEGCKCTSCKKSCCSCCPAECEKCAKDCVCKGGEAAEAEAEKCSCCQ

SEQ ID NO: 829171 - protein, 111 aa, Homo sapiens
GSARTAAASGSCTRMRGGSGGARAGVGERAPAVHTHGRGGRQMQCVRRSPSAQTERAGAVRRGGRPAGLACAPPPEAIKASPPAATSQAARPVAWRSPFTASSCCSPRHGP

SEQ ID NO: 829172 - protein, 96 aa, Homo sapiens
SATRLNRSGVLENSRMKGKRGREELGNTQSAFFSTFGDGGSCTCADSCKCEGCKCTSCKKSCCSCCPAECEKCAKDCVCKGGEAAEAEAEKCSCCQ

SEQ ID NO: 829173 - protein, 91 aa, Homo sapiens
HQAHFCRPQDPHELTSNEFIGLSARRCQVRLRLPSNLLLSLHVILCSEKCAWVRTQAHFWWLLHLRGLLQVRGMQMHLLQEELLLLLPCGV

SEQ ID NO: 829174 - protein, 128 aa, Homo sapiens; identical to SEQ ID NO: 829170

SEQ ID NO: 829175 - protein, 111 aa, Homo sapiens; identical to SEQ ID NO: 829171

SEQ ID NO: 829176 - protein, 111 aa, Homo sapiens; identical to SEQ ID NO: 829171

SEQ ID NO: 829177 - protein, 117 aa, Homo sapiens
SVVPHVHLPPCSCSRCLKRKASWGSTTIRGPRVAQYDGRIGMKREMTRSAPGCAPRRTSGGSCTCADSCKCEGCKCTSCKKSCCSCCPAECEKCAKDCVCKGGEAAEAEAEKCSCCQ

SEQ ID NO: 829178 - protein, 104 aa, Homo sapiens
MSDKSWPAKTILLLLLFLLLVLPHIMGVILTPLCRSAPGCAPRRTSGGSCTCADSCKCEGCKCTSCKKSCCSCCPAECEKCAKDCVCKGGEAAEAEAEKCSCCQ

SEQ ID NO: 829179 - protein, 111 aa, Homo sapiens; identical to SEQ ID NO: 829171

SEQ ID NO: 829180 - protein, 36 aa, Homo sapiens
AHCWIKGAAPTGHFHGLHLASRPCARSAEPLCQPSG

SEQ ID NO: 829181 - protein, 472 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 829182 - protein, 199 aa, Homo sapiens
LGLGLGGGGRPGAGASELFPSVTTDLSVSKQKVCLTCVDFVTVHVCMGFWGIGPGALSTSCIPYPLSHGPGSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQVSIPGQS

SEQ ID NO: 829183 - protein, 430 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSISALERDPIDRP

SEQ ID NO: 829184 - protein, 430 aa, Homo sapiens; identical to SEQ ID NO: 829183

SEQ ID NO: 829185 - protein, 449 aa, Homo sapiens
QRLGQGSPSLSPTLSSLNRMELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSISALERDPIDRP

SEQ ID NO: 829186 - protein, 472 aa, Homo sapiens; identical to SEQ ID NO: 829181

SEQ ID NO: 829187 - protein, 680 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATARAACLDTDQALLAQVPVRMHMEGSGPLPRVPPAQHVEVAGSHERGCQRRGTAEAADWPTSLLPRDAKLGMSVFTSATPFMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKEEEEEEEEEEARSWWSLCPAQSSLPPPG

SEQ ID NO: 829188 - protein, 379 aa, Homo sapiens
MSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSISALERDPIDRP

SEQ ID NO: 829189 - protein, 454 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSISALDFQSGDAANVLIFVNPEPGALTRTLRASISAW

SEQ ID NO: 829190 - protein, 423 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTCSRQQYDITTQMKRER

SEQ ID NO: 829191 - protein, 225 aa, Homo sapiens
LGLGLGGGGRPGAGASELFPSVTTDLSVSKQKVCLTCVDFVTVHVCMGFWGIGPGALSTSCIPYPLSHGPGSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 829192 - protein, 257 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYRSSIGLCYRPHGTGWKGTLVDPSHDKEWEPISVGRFYGPMVLF

SEQ ID NO: 829193 - protein, 447 aa, Homo sapiens
MRMPLTVAALTLTVPVVTCKIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRIVWTLIRPCWPRSLCACTWRGQGRSLGSLLPNMWRWLVPMNVVVRGGGQQRLQTGPLPSSPGMPSLDHGPNPNPNPMGGGGGGRRGGGGGGGGGGGGGQVLVEPLPSPVLSASSWLKLFVRITLGLKRKNKDVELPKKTLKTTQKKTRGHTNFGGRTKTVTNSAHSQHKVPEPPPCHHGGKTARDPPKEHHIIENTGKPGSSNRNEAHDSNTADRRGKDDDTTQTSSHDTENITLHNKTPKTGKEKTKETTDPNERCKNATQTTYSREQEKISNEQNEHNTRNKYCTNKKDDEGYREDNHTEPSSSGLRWTAADS

SEQ ID NO: 829194 - protein, 202 aa, Homo sapiens
MHGWKDEWRMDGWMDRCINGWIKEWDDGWMDGWMDKWMDGCTHGWMDAWMKDGWVNEWEDGLMEARSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSISALDFQSGDAANVLIFVNPEPGALTRTLRASISAW

SEQ ID NO: 829195 - protein, 263 aa, Homo sapiens
MARETAMELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYRSSIGLCYRPHGTGWKGTLVDPSHDKEWEPISVGRFYGPMVLF

SEQ ID NO: 829196 - protein, 480 aa, Homo sapiens
WPRGEGGGKERGWRGGPGNERHRWQERQRESGVWEERLSLLHVVGSSALGMELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSISALERDPIDRP

SEQ ID NO: 829197 - protein, 436 aa, Homo sapiens
MARETAMELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSISALERDPIDRP

SEQ ID NO: 829198 - protein, 474 aa, Homo sapiens
SEIPPSQGVSAGGSWGFFRDAVPTRQGLQARVGIAETPPPQETRMELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSISALERDPIDRP

SEQ ID NO: 829199 - protein, 243 aa, Homo sapiens
MKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSISALERDPIDRP

SEQ ID NO: 829200 - protein, 243 aa, Homo sapiens; identical to SEQ ID NO: 829199

SEQ ID NO: 829201 - protein, 291 aa, Homo sapiens
RLVPPEVWISSTHGAPSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 829202 - protein, 217 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVSHREA

SEQ ID NO: 829203 - protein, 118 aa, Homo sapiens
MSLLNKPKSEMTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 829204 - protein, 118 aa, Homo sapiens; identical to SEQ ID NO: 829203

SEQ ID NO: 829205 - protein, 118 aa, Homo sapiens; identical to SEQ ID NO: 829203

SEQ ID NO: 829206 - protein, 282 aa, Homo sapiens
LPRVSPLLACILCPALGPPYPGEALLLGGPRGVSPSVFRGATPIERSGDQRAYSVIRGNRAWWATISSRLSPLALCPPPEILSVIRVSLVSHSMAKCRPLGVAGVRPRSRPRLICRPMIGGPQGNFSAFHSGGDASGPPTRCWPGSPSSLLGEPPSFSSGVVTLMSLLNKPKSEMTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 829207 - protein, 118 aa, Homo sapiens; identical to SEQ ID NO: 829203

SEQ ID NO: 829208 - protein, 118 aa, Homo sapiens; identical to SEQ ID NO: 829203

SEQ ID NO: 829209 - protein, 118 aa, Homo sapiens; identical to SEQ ID NO: 829203

SEQ ID NO: 829210 - protein, 118 aa, Homo sapiens; identical to SEQ ID NO: 829203

SEQ ID NO: 829211 - protein, 118 aa, Homo sapiens; identical to SEQ ID NO: 829203

SEQ ID NO: 829212 - protein, 118 aa, Homo sapiens; identical to SEQ ID NO: 829203

SEQ ID NO: 829213 - protein, 138 aa, Homo sapiens
IILVSVLFLRRPPLPSRSPFLSDTTPTPFEMTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 829214 - protein, 118 aa, Homo sapiens; identical to SEQ ID NO: 829203

SEQ ID NO: 829215 - protein, 118 aa, Homo sapiens; identical to SEQ ID NO: 829203

SEQ ID NO: 829216 - protein, 118 aa, Homo sapiens; identical to SEQ ID NO: 829203

SEQ ID NO: 829217 - protein, 118 aa, Homo sapiens; identical to SEQ ID NO: 829203

SEQ ID NO: 829218 - protein, 118 aa, Homo sapiens; identical to SEQ ID NO: 829203

SEQ ID NO: 829219 - protein, 139 aa, Homo sapiens
MSLLNKPKSEMTPEELQKREEEEFNTGPLSVLTQSVKNNTQVLINCRNNKKLLGRVKAFDRHCNMVLENVKEMWTEVPKSGKGKKKSKPVNKDRYISKMFLRGGKPLFFPQKGGFSPPGAACLLTELTPLSYEDRCHWC

SEQ ID NO: 829220 - protein, 108 aa, Homo sapiens
MTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 829221 - protein, 95 aa, Homo sapiens
MSLLNKPKSEMTPEELQKREEEEFNTGPLSVLTQSVKNNTQEAYNNLILDGRLRSEIYTGEKFKPIDVQTDYFLYTLLLFQRKAGIPNEESILGG

SEQ ID NO: 829222 - protein, 139 aa, Homo sapiens
PSFRFNSNAEETGVNRERSYIMSLLNKPKSEMTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 829223 - protein, 118 aa, Homo sapiens; identical to SEQ ID NO: 829203

SEQ ID NO: 829224 - protein, 89 aa, Homo sapiens
GVNGERVTIMSLLNKPKSEMTPEELQKREEEEFNTGPLSVLTQSVKNNTQVLINCRNNKKLLGRVKAFDRHCLVLEVSIAPPGSNGFNQ

SEQ ID NO: 829225 - protein, 108 aa, Homo sapiens; identical to SEQ ID NO: 829220

SEQ ID NO: 829226 - protein, 108 aa, Homo sapiens; identical to SEQ ID NO: 829220

SEQ ID NO: 829227 - protein, 118 aa, Homo sapiens; identical to SEQ ID NO: 829203

SEQ ID NO: 829228 - protein, 118 aa, Homo sapiens; identical to SEQ ID NO: 829203

SEQ ID NO: 829229 - protein, 118 aa, Homo sapiens; identical to SEQ ID NO: 829203

SEQ ID NO: 829230 - protein, 118 aa, Homo sapiens; identical to SEQ ID NO: 829203

SEQ ID NO: 829231 - protein, 118 aa, Homo sapiens; identical to SEQ ID NO: 829203

SEQ ID NO: 829232 - protein, 118 aa, Homo sapiens; identical to SEQ ID NO: 829203

SEQ ID NO: 829233 - protein, 105 aa, Homo sapiens
MSLLNKPKSEMTPEELQKREEEEFNTGPLSVLTQSVKNNTQVLINCRNNKKLLGRVKAFDRHCNMVLENVKEMWTEVNKDRYISKMFLRGDSVIVVLRNPLIAGK

SEQ ID NO: 829234 - protein, 108 aa, Homo sapiens
AELLWQLGHPGLAPAPFPKPCCWRGRAAGSRGHCQRHAPHAQCLPSLFPTRHCNMVLENVKEMWTEVPKSGKGKKKSKPVNKDRYISKMFLRGDSVIVVLRNPLIAGK

SEQ ID NO: 829235 - protein, 306 aa, Homo sapiens
PSVLVPAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEVGATRSGAGRRGRLKALLVPSLPRSYWRLGNEVTD

SEQ ID NO: 829236 - protein, 96 aa, Homo sapiens
HGSMKEMVGGCCVCSDERGWAENPLVYCDGHACSVAVHQACYGIVQVPTGPWFCRKCESQERAARVRCELCPHKDGALKRTDNGGEAGSSAEVSRA

SEQ ID NO: 829237 - protein, 1096 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAVSSLQSSPDFSAFPKLEQPEEDKYSKPTAPAPSAPPSPSAPEPPKADLFEQKVVFSGFGPIMRFSTTTSSSGRARAPSPGDYKSPHVTGSGASAGTHKRMPALSATPVPADETPETGLKEKKHKASKRSRHGPGRPKGSRNKEGTGGPAAPSLPSAQLAGFTATAASPFSGGSLVSSGLGGLSSRTFGPSGSLPSLSLESPLLGAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEDPHSGCPSRSSSSLSFHSTPPPLPLLQQSPATLPLALPGAPAPLPPQPQNGLGRAPGAAGLGAMPMAEGLLGGLAGSGGLPLNGLLGGLNGAAAPNPASLSQAGGAPTLQLPGCLNSLTEQQRHLLQQQEQQLQQLQQLLASPQLTPEHQTVVYQMIQQIQQKRELQRLQMAGGSQLPMASLLAGSSTPLLSAGTPGLLPTASAPPLLPAGALVAPSLGNNTSLMAAAAAAAAVAAAGGPPVLTAQTNPFLSLSGAEGSGGGPKGGTADKGASANQEKG

SEQ ID NO: 829238 - protein, 1096 aa, Homo sapiens; identical to SEQ ID NO: 829237

SEQ ID NO: 829239 - protein, 424 aa, Homo sapiens [sequence omitted]

SEQ ID NO: 829240 - protein, 1096 aa, Homo sapiens; identical to SEQ ID NO: 829237

SEQ ID NO: 829241 - protein, 105 aa, Homo sapiens
AAQNLESNGRVIFCPQCLSYPICEGEDSDDNAIVHLKTQPRCRSVGTKSNACPMINVSTWEWEIVCECVCACMCVCVCVCVCVCLPVSLLLDPGQPRAGIGAVVR

SEQ ID NO: 829242 - protein, 1096 aa, Homo sapiens; identical to SEQ ID NO: 829237

SEQ ID NO: 829243 - protein, 1096 aa, Homo sapiens; identical to SEQ ID NO: 829237

SEQ ID NO: 829244 - protein, 1096 aa, Homo sapiens; identical to SEQ ID NO: 829237

SEQ ID NO: 829245 - protein, 852 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAVSSLQSSPDFSAFPKLEQPEEDKYSKPTAPAPSAPPSPSAPEPPKADLFEQKVVFSGFGPIMRFSTTTSSSGRARAPSPGDYKSPHVTGSGASAGTHKRMPALSATPVPADETPETGLKEKKHKASKRSRHGPGRPKGSRNKEGTGGPAAPSLPSAQLAGFTATAASPFSGGSLVSSGLGGLSSRTFGPSGSLPSLSLESPLLGAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEVGATRSGAGRRGRLKALLVPSLPRSYWRLGNEVTD

SEQ ID NO: 829246 - protein, 1035 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAVSSLQSSPDFSAFPKLEQPEEDKYSKPTAPAPSAPPSPSAPEPPKADLFEQKVVFSGFGPIMRFSTTTSSSGRARAPSPGDYKSPHVTGSGASAGTHKRMPALSATPVPADETPETGLKEKKHKASKRSRHGPGRPKGSRNKEGTGGPAAPSLPSAQLAGFTATAASPFSGGSLVSSGLGGLSSRTFGPSGSLPSLSLESPLLGAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEDPHSGCPSRSSSSLSFHSTPPPLPLLQQSPATLPLALPGAPAPLPPQPQNGLGRAPGAAGLGAMPMAEGLLGGLAGSGGLPLNGLLGGLNGAAAPNPASLSQAGGAPTLQLPGCLNSLTEQQRHLLQQQEQQLQQLQQLLASPQLTPEHQTVVYQMIQQIQQKRELQRLQMAGGSQLPMASLLAGSSTPLLSAGTPGLLPTASAPPSFSFFALVSSAQ

SEQ ID NO: 829247 - protein, 652 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAVSSLQSSPDFSAFPKLEQPEEDKYSKPTAPAPSAPPSPSAPEPPKADLFEQKVVFSGFGPIMRFSTTTSSSGRARAPSPGDYKSPHVTGSGASAGTHKRMPALSATPVPADETPETGLKEKKHKASKRSRHGPGRPKGSRNKEGTGGPAAPSLPSAQLAGFTATAASPFSGGSLVSSGLGGLSSRTFGPSGSLPSLSLESPLLGAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTGM

SEQ ID NO: 829248 - protein, 120 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYPISDSWL

SEQ ID NO: 829249 - protein, 148 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKVSGPPPCPLPVPSHLWVPPTLSSSGVI

SEQ ID NO: 829250 - protein, 1096 aa, Homo sapiens; identical to SEQ ID NO: 829237

SEQ ID NO: 829251 - protein, 687 aa, Homo sapiens
MRFSTTTSSSGRARAPSPGDYKSPHVTGSGASAGTHKRMPALSATPVPADETPETGLKEKKHKASKRSRHGPGRPKGSRNKEGTGGPAAPSLPSAQLAGFTATAASPFSGGSLVSSGLGGLSSRTFGPSGSLPSLSLESPLLGAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEDPHSGCPSRSSSSLSFHSTPPPLPLLQQSPATLPLALPGAPAPLPPQPQNGLGRAPGAAGLGAMPMAEGLLGGLAGSGGLPLNGLLGGLNGAAAPNPASLSQAGGAPTLQLPGCLNSLTEQQRHLLQQQEQQLQQLQQLLASPQLTPEHQTVVYQMIQQIQQKRELQRLQMAGGSQLPMASLLAGSSTPLLSAGTPGLLPTASAPPLLPAGALVAPSLGNNTSLMAAAAAAAAVAAAGGPPVLTAQTNPFLSLSGAEGSGGGPKGGTADKGASANQEKG

SEQ ID NO: 829252 - protein, 572 aa, Homo sapiens
PPTTGPPRKEVPKTTPSEPKKKQPPPPESGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEDPHSGCPSRSSSSLSFHSTPPPLPLLQQSPATLPLALPGAPAPLPPQPQNGLGRAPGAAGLGAMPMAEGLLGGLAGSGGLPLNGLLGGLNGAAAPNPASLSQAGGAPTLQLPGCLNSLTEQQRHLLQQQEQQLQQLQQLLASPQLTPEHQTVVYQMIQQIQQKRELQRLQMAGGSQLPMASLLAGSSTPLLSAGTPGLLPTASAPPLLPAGALVAPSLGNNTSLMAAAAAAAAVAAAGGPPVLTAQTNPFLSLSGAEGSGGGPKGGTADKGASANQEKG

SEQ ID NO: 829253 - protein, 1096 aa, Homo sapiens; identical to SEQ ID NO: 829237

SEQ ID NO: 829254 - protein, 1096 aa, Homo sapiens; identical to SEQ ID NO: 829237

SEQ ID NO: 829255 - protein, 1036 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAVSSLQSSPDFSAFPKLEQPEEDKYSKPTAPAPSAPPSPSAPEPPKADLFEQKVVFSGFGPIMRFSTTTSSSGRARAPSPGDYKSPHVTGSGASAGTHKRMPALSATPVPADETPETGLKEKKHKASKRSRHGPGRPKGSRNKEGTGGPAAPSLPSAQSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEDPHSGCPSRSSSSLSFHSTPPPLPLLQQSPATLPLALPGAPAPLPPQPQNGLGRAPGAAGLGAMPMAEGLLGGLAGSGGLPLNGLLGGLNGAAAPNPASLSQAGGAPTLQLPGCLNSLTEQQRHLLQQQEQQLQQLQQLLASPQLTPEHQTVVYQMIQQIQQKRELQRLQMAGGSQLPMASLLAGSSTPLLSAGTPGLLPTASAPPLLPAGALVAPSLGNNTSLMAAAAAAAAVAAAGGPPVLTAQTNPFLSLSGAEGSGGGPKGGTADKGASANQEKG

SEQ ID NO: 829256 - protein, 254 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQN

SEQ ID NO: 829257 - protein, 655 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAVSSLQSSPDFSAFPKLEQPEEDKYSKPTAPAPSAPPSPSAPEPPKADLFEQKVVFSGFGPIMRFSTTTSSSGRARAPSPGDYKSPHVTGSGASAGTHKRMPALSATPVPADETPETGLKEKKHKASKRSRHGPGRPKGSRNKEGTGGPAAPSLPSAQLAGFTATAASPFSGGSLVSSGLGGLSSRTFGPSGSLPSLSLESPLLGAGIYTSNKDPISHSGGMLRAVCSTPLSSSLLGPPGTSALPRLSRSPFTSTLPSSSASISTTQVGHPSPACDPRKNGRAFWLPPPSGHCPPCKNKQAGCGGSRL

SEQ ID NO: 829258 - protein, 402 aa, Homo sapiens
HGSMKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAGECGHPGGSWEPGKPFVLSFSGRDFAYWVCISFTSPLVQDKDGESPPPPTCLYV

SEQ ID NO: 829259 - protein, 144 aa, Homo sapiens
REAGLRAGSPSAAGGLAWVSLALGSGSRGRDHSGSGVGTAMAGALVRKAADYVRSKDFRDYLMSTHFWGPVANWGLPIAAINDMKKSPEIISGRMTFALCCYSLTFMRFAYKVQPRNWLLFACHATNEVAQLIQGRAAYQTRDD

SEQ ID NO: 829260 - protein, 144 aa, Homo sapiens; identical to SEQ ID NO: 829259

SEQ ID NO: 829261 - protein, 111 aa, Homo sapiens
MLVTPSKQSSKQKNALKILCGHKFELVIMVIEILVPNSARGRGRDHSGSGVGTAMAGALVRKAADYVRSKDFRDYLMSRTIRDDLVVVWKPVGTLGSCQTLSSSGLSCKNC

SEQ ID NO: 829262 - protein, 157 aa, Homo sapiens
REAGLRAGSPSAAGGLAWVSLALGSGSRGRDHSGSGVGTAMAGALVRKAADYVRSKDFRDYLMSTHFWGPVANWGLPIAAINDMKKSPEIISGRMTFALCCYSLTFMRFAYKVQPRNWLLFACHATNEVAQLIQGRAAYQTRGQHCQLLLSHRFHYK

SEQ ID NO: 829263 - protein, 144 aa, Homo sapiens; identical to SEQ ID NO: 829259

SEQ ID NO: 829264 - protein, 158 aa, Homo sapiens
MLVTPSKQSSKQKNALKILCGHKFELVIMVIEILVPNSARGRGRDHSGSGVGTAMAGALVRKAADYVRSKDFRDYLMSTHFWGPVANWGLPIAAINDMKKSPEIISGRMTFALCCYSLTFMRFAYKVQPRNWLLFACHATNEVAQLIQGRAAYQTRDD

SEQ ID NO: 829265 - protein, 144 aa, Homo sapiens; identical to SEQ ID NO: 829259

SEQ ID NO: 829266 - protein, 144 aa, Homo sapiens; identical to SEQ ID NO: 829259

SEQ ID NO: 829267 - protein, 124 aa, Homo sapiens
MLVTPSKQSSKQKNALKILCGHKFELVIMVIEILVPNSARGRGRDHSGSGVGTAMAGALVRKAADYVRSKDFRDYLMSTHFWGPVANWGLPIAAINDMKKSPEIISGRMTFASELASVCMPRNK

SEQ ID NO: 829268 - protein, 69 aa, Homo sapiens
MVIEILVPNSARGRGRDHSGSGVGTAMAGALVRKAADYVRSKDFRDYLMSHRTGSGVVTAMAARCRKRR

SEQ ID NO: 829269 - protein, 477 aa, Homo sapiens
HEAEAAGLARVEPPRRSSGVGAARLRFPGGSRPLRARACVLALAVLALLERNNADSMSAHSMLCERIAIAKELIKRAESLSRSRKGGIEGGAKLCSKLKAELKFLQKVEAGKVAIKESHLQSTNLTHLRAIVESAENLEEVVSVLHVFGYTDTLGEKQTLVVDVVANGGHTWVKAIGRKAEALHNIWLGRGQYGDKSIIEQAEDFLQASHQQPVQYSNPHIIFAFYNSVSSPMAEKLKEMGISVRGDIVAVNALLDHPEELQPSESESDDEGPELLQVTRVDRENILASVAFPTEIKVDVCKRVNLDITTLITYVSALSYGGCHFIFKEKVLTEQAEQERKEQVLPQLEAFMKDKELFACESAVKDFQSILDTLGGPGERERATVLIKRINVVPDQPSERALRLVASSKINSRSLTIFGTGDTLKAITMTANSGFVRAANNQGVKFSVFIHQPRALTESKEALATPLPKDYTTDSEH

SEQ ID NO: 829270 - protein, 160 aa, Homo sapiens
HEAEAAGLARVEPPRRSSGVGAARLRFPGGSRPLRARACVLALAVLALLERNNADSMSAHSMLCERIAIAKELIKRAESLSRSRKGGIEGGAKLCSKLKAELKFLQKVEAGKVAIKESHLQSTNLTHLRAIVESAENLEEVVSVLHVFGYTDTLGEKLHN

SEQ ID NO: 829271 - protein, 477 aa, Homo sapiens; identical to SEQ ID NO: 829269

SEQ ID NO: 829272 - protein, 477 aa, Homo sapiens; identical to SEQ ID NO: 829269

SEQ ID NO: 829273 - protein, 435 aa, Homo sapiens
MRHTQAQERNNADSMSAHSMLCERIAIAKELIKRAESLSRSRKGGIEGGAKLCSKLKAELKFLQKVEAGKVAIKESHLQSTNLTHLRAIVESAENLEEVVSVLHVFGYTDTLGEKQTLVVDVVANGGHTWVKAIGRKAEALHNIWLGRGQYGDKSIIEQAEDFLQASHQQPVQYSNPHIIFAFYNSVSSPMAEKLKEMGISVRGDIVAVNALLDHPEELQPSESESDDEGPELLQVTRVDRENILASVAFPTEIKVDVCKRVNLDITTLITYVSALSYGGCHFIFKEKVLTEQAEQERKEQVLPQLEAFMKDKELFACESAVKDFQSILDTLGGPGERERATVLIKRINVVPDQPSERALRLVASSKINSRSLTIFGTGDTLKAITMTANSGFVRAANNQGVKFSVFIHQPRALTESKEALATPLPKDYTTDSEH

SEQ ID NO: 829274 - protein, 499 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 829275 - protein, 499 aa, Homo sapiens; identical to SEQ ID NO: 829274

SEQ ID NO: 829276 - protein, 478 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 829277 - protein, 499 aa, Homo sapiens; identical to SEQ ID NO: 829274

SEQ ID NO: 829278 - protein, 439 aa, Homo sapiens
MSDGSKTSKFLQEGNHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 829279 - protein, 492 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIN

SEQ ID NO: 829280 - protein, 68 aa, Homo sapiens
CSARARAAHMHHLIIYSFLYIVYTSTTGMFHTNLNYCWQNNRGRLDKKKNPQYSKYNSSSSFSVNAKI

SEQ ID NO: 829281 - protein, 293 aa, Homo sapiens [sequence omitted]

SEQ ID NO: 829282 - protein, 293 aa, Homo sapiens [sequence omitted]

SEQ ID NO: 829283 - protein, 499 aa, Homo sapiens; identical to SEQ ID NO: 829274

SEQ ID NO: 829284 - protein, 478 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIN

SEQ ID NO: 829285 - protein, 293 aa, Homo sapiens [sequence omitted]

SEQ ID NO: 829286 - protein, 478 aa, Homo sapiens; identical to SEQ ID NO: 829276

SEQ ID NO: 829287 - protein, 243 aa, Homo sapiens
SLTTVKSPTFPGSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 829288 - protein, 243 aa, Homo sapiens; identical to SEQ ID NO: 829287

SEQ ID NO: 829289 - protein, 243 aa, Homo sapiens; identical to SEQ ID NO: 829287

SEQ ID NO: 829290 - protein, 243 aa, Homo sapiens; identical to SEQ ID NO: 829287

SEQ ID NO: 829291 - protein, 243 aa, Homo sapiens; identical to SEQ ID NO: 829287

SEQ ID NO: 829292 - protein, 109 aa, Homo sapiens
MGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 829293 - protein, 160 aa, Homo sapiens [sequence omitted]

SEQ ID NO: 829294 - protein, 128 aa, Homo sapiens [sequence omitted]

SEQ ID NO: 829295 - protein, 243 aa, Homo sapiens; identical to SEQ ID NO: 829287

SEQ ID NO: 829296 - protein, 111 aa, Homo sapiens
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQ

SEQ ID NO: 829297 - protein, 111 aa, Homo sapiens; identical to SEQ ID NO: 829296

SEQ ID NO: 829298 - protein, 559 aa, Homo sapiens
MAAVGRVGSFGSSPPGLSSTYTGGPLGNEIASGNGGAAAGDDEDGQNLWSCILSEVSTRSRSKLPAGKNVLLLGEDGAGKTSLIRKIQGIEEYKKGRGLEYLYLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRFLKIPNKAIYSVFWDNVNMPLPFPSKVELESWSASSDGLNLCRVCVCVCVWLPIF

SEQ ID NO: 829299 - protein, 488 aa, Homo sapiens
GQPAQPRPASPPDLSRMAGREGEHETLDPGPAGTRPPSGEDGAGKTSLIRKIQGIEEYKKGRGLEYLYLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRKPVTVSPTTPTSPTEGEAS

SEQ ID NO: 829300 - protein, 156 aa, Homo sapiens [sequence omitted]

SEQ ID NO: 829301 - protein, 523 aa, Homo sapiens
MAAVGRVGSFGSSPPGLSSTYTGGPLGNEIASGNGGAAAGDDEDGQNLWSCILSEVSTRSRSKLPAGKNVLLLGEDGAGKTSLIRKIQGIEEYKKGRGLEYLYLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRKPVTVSPTTPTSPTEGEAS

SEQ ID NO: 829302 - protein, 523 aa, Homo sapiens; identical to SEQ ID NO: 829301

SEQ ID NO: 829303 - protein, 505 aa, Homo sapiens
MAAVGRVGSFGSSPPGLSSTYTGGPLGNEIASGNGGAAAGDDEDGQNLWSCILSEVSTRSRSKLPAGKNVLLLGEDGAGKTSLIRLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRKPVTVSPTTPTSPTEGEAS

SEQ ID NO: 829304 - protein, 541 aa, Homo sapiens
MAAVGRVGSFGSSPPGLSSTYTGGPLGNEIASGNGGAAAGDDEDGQNLWSCILSEVSTRSRSKLPAGKNVLLLGEDGAGKTSLIRKIQGIEEYKKGRGLEYLYLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRKPVTVSPTTPTLSPENRINGFIWYLQEASPSVGDVGR

SEQ ID NO: 829305 - protein, 132 aa, Homo sapiens
GLPRLLLLSMAALGTVLFTGVRRLHCSAAAWAGGQWRLQQGLAANPSGYGPLTELPDWSYADGRPAPPMKGQLRRKAERETFARRVVLLSQEMDAGLQAWQLRQQKLQEEQRKQENALKPKGASLKSPLPSQ

SEQ ID NO: 829306 - protein, 132 aa, Homo sapiens; identical to SEQ ID NO: 829305

SEQ ID NO: 829307 - protein, 73 aa, Homo sapiens
RATPATPAQHGCFRDCSLHRCPEAALQRSRLGGRPVATTAGTGCQPLRLRAPYRAPRLVICGGMILLNWIIGD

SEQ ID NO: 829308 - protein, 96 aa, Homo sapiens
GLPRLLLLSMAALGTVLFTGVRRLHCSAAAWAGGQWRLQQGLAANPSGYGPLTELPDWSYAETSCTAVTGNGRWITSMAAQAAEVAGRTKEAGKCS

SEQ ID NO: 829309 - protein, 154 aa, Homo sapiens
KSSTYVKNGTSFNIHYVSGSLSGYLSQDTVMVPCQSASSASALGGVKVERQVFGEATKQPGITFIAAKFDGILGMAYPRISVNNVLPVFDNLMQLRRKAERETFARRVVLLSQEMDAGLQAWQLRQQKLQEEQRKQENALKPKGASLKSPLPSQ

SEQ ID NO: 829310 - protein, 117 aa, Homo sapiens
AAAYYYYIRGRVDTEYSSLHTRTSHCCSMSSQQQKQPCIPPPQLQQQQVKQPCQPPPQEPCIPKTKEPCHPKVPEPCHPKVPEPCQPKVPEPCHPKVPEPCPSIVTPAPAQQKTKQK

SEQ ID NO: 829311 - protein, 120 aa, Homo sapiens
SRGSPTTYFRPVLRDHTEYSSLHTRTSHCCSMSSQQQKQPCIPPPQLQQQQVKQPCQPPPQEPCIPKTKEPCHPKVPEPCHPKVPEPCQPKVPEPCHPKVPEPCPSIVTPAPAQQKTKQK

SEQ ID NO: 829312 - protein, 120 aa, Homo sapiens; identical to SEQ ID NO: 829311

SEQ ID NO: 829313 - protein, 147 aa, Homo sapiens
SRGSPTTYFRPVLRDHTEYSSLHTRTSHCCSMSSQQQKQPCIPPPQLQQQQVKQPCQPPPQEPCIPKTKEPCHPKVPEPCHPKVPEPCQPKVPEPCHPKVPEPCPSIVTPAPAQQTVAAMSSQQQKQPCIPPPQLQQQQVKQPCQPP

SEQ ID NO: 829314 - protein, 477 aa, Homo sapiens
RTYTIRNEHVDYVDVGGAYVGPTQNRILRLSKELGIETYKVDVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 829315 - protein, 369 aa, Homo sapiens
MVSSRNKPWRTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 829316 - protein, 477 aa, Homo sapiens; identical to SEQ ID NO: 829314

SEQ ID NO: 829317 - protein, 477 aa, Homo sapiens; identical to SEQ ID NO: 829314

SEQ ID NO: 829318 - protein, 477 aa, Homo sapiens; identical to SEQ ID NO: 829314

SEQ ID NO: 829319 - protein, 399 aa, Homo sapiens
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGFAPDYYDWGQQTNSFLAQAGTLQDSTLDPDKPSLG

SEQ ID NO: 829320 - protein, 109 aa, Homo sapiens
ALMPSRLPLYLASLFISLVFLLVNLTCAVLVKTGNWERKVIVSVRVAINDTLFVLCAVSLSICLYKISKMSLANIYLESKVGGNVVKIPPMKRVLKRVSWFAKVHFDEF

SEQ ID NO: 829321 - protein, 326 aa, Homo sapiens
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTFLM

SEQ ID NO: 829322 - protein, 180 aa, Homo sapiens
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVAPLPGLPLHQPCFPVGEFNLCCAGKDGKLGEEGYRLCASGH

SEQ ID NO: 829323 - protein, 155 aa, Homo sapiens
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQNSLKKVPVLSPFSRGGN

SEQ ID NO: 829324 - protein, 399 aa, Homo sapiens; identical to SEQ ID NO: 829319

SEQ ID NO: 829325 - protein, 399 aa, Homo sapiens; identical to SEQ ID NO: 829319

SEQ ID NO: 829326 - protein, 218 aa, Homo sapiens
METPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQGSSVCQVTAIGVTVILLYTSRACYNLFILSFSQNKSVHSFDYDWYNVSDQVSGGAEEVSPDQGLLVSSRHWFQDPRKYQNLDAQVPDIKWCSICI

SEQ ID NO: 829327 - protein, 432 aa, Homo sapiens
METPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQNSLKKVPVIVPIFQRRKLRLRGRRDLLKVTLSVHGGAGIQHTSVLSECVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGFAPDYYDWGQQTNSFLAQAGTLQDSTLDPDKPSLG

SEQ ID NO: 829328 - protein, 234 aa, Homo sapiens
SLRRSDGFIRGFRFCFFLIFFSLLLPCKKCLSPPTVILRLPQPCGTVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTFLM

SEQ ID NO: 829329 - protein, 375 aa, Homo sapiens
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGKNTLDLPIPKF

SEQ ID NO: 829330 - protein, 144 aa, Homo sapiens
MRVRKCSTPEEIKKRTKAVIFLSQCRQKVHHVEGKEILVGDVGVTISEPFKHFVGMLPEKDCCYALYDASFETKESRRIDVFLWASELAPLKSKMIYTSSKDAIKKKFQGIKHEWQTNGPEDLNRACTAEKLGGSFFFFFEMES

SEQ ID NO: 829331 - protein, 48 aa, Homo sapiens
MAPQVGPQGNPGARAMRWASPPHKKTPGGTPEVSETIPKGGSGSQTGS

SEQ ID NO: 829332 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 829333 - protein, 105 aa, Homo sapiens; identical to SEQ ID NO: 829332

SEQ ID NO: 829334 - protein, 72 aa, Homo sapiens
RVRYPHKGNVAKISSPTETERCIESLIAVFQKYAGKDGYNYTLSQDRVPKLHEYRTSCLHKEPEGPLVSLTA

SEQ ID NO: 829335 - protein, 87 aa, Homo sapiens
DDFIIHCNSRSHSALGCGCVGSSNMAKISSPTETERCIESLIAVFQKYAGKDGYNYTLSQDRVPKLHEYRTSCLHKEPEGPLVSLTA

SEQ ID NO: 829336 - protein, 106 aa, Homo sapiens
MDQFEICSLVKSLTLIEGWPHILMFGHPLARICLVEQTFVASQMAKISSPTETERCIESLIAVFQKYAGKDGYNYTLSQDRVPKLHEYRTSCLHKEPEGPLVSLTA

SEQ ID NO: 829337 - protein, 105 aa, Homo sapiens; identical to SEQ ID NO: 829332

SEQ ID NO: 829338 - protein, 65 aa, Homo sapiens
GSPAEFRRVDTARENDRRVEERLQTRTPRAQSSQRRSQPQPPAPRSAPTWQKSPALQRLSGASSP

SEQ ID NO: 829339 - protein, 81 aa, Homo sapiens
IRLVEAGGESAEASLSSYMAKISSPTETERCIESLIAVFQKYAGKDGYNYTLSQDRVPKLHEYRTSCLHKEPEGPLVSLTA

SEQ ID NO: 829340 - protein, 86 aa, Homo sapiens
AADYYYYCSEFKLLTMYGDMAKISSPTETERCIESLIAVFQKYAGKDGYNYTLSQDRVPKLHVPVIPATQEAEAGESLEPRRQRLQ

SEQ ID NO: 829341 - protein, 105 aa, Homo sapiens; identical to SEQ ID NO: 829332

SEQ ID NO: 829342 - protein, 92 aa, Homo sapiens
LGHIEPIGGIRSNTIGEDSSMYSEPDITKEAKISSPTETERCIESLIAVFQKYAGKDGYNYTLSQDRVPKLHEYRTSCLHKEPEGPLVSLTA

SEQ ID NO: 829343 - protein, 154 aa, Homo sapiens
GSPAEFRRVDTARETTEGLRRGSRPARRAHRALSAAPSHSPVAHAVLAKLNAFKADTPSLGEGPEKTRSQLLIMDRAADPVSPLLHELSSNMAKISSPTETERCIESLIAVFQKYAGKDGYNYTLSQDRVPKLHEYRTSCLHKEPEGPLVSLTA

SEQ ID NO: 829344 - protein, 216 aa, Homo sapiens
MPDGRESAPRHVRHRSRKIVSAESEDHATSCGPKTAASERERLHKFKAAELHKLAPGTLLNAGPQESCNTGEETLSGPTLGPKGGPGKASTARHDRSDQHPDLGLPEAPGARPSFDIERGCWLQFTSGEQQELKTLGATILGPTASRASLSSNMAKISSPTETERCIESLIAVFQKYAGKDGYNYTLSQDRVPKLHEYRTSCLHKEPEGPLVSLTA

SEQ ID NO: 829345 - protein, 105 aa, Homo sapiens
LSPGTATRIRAPLRAPRCRYHTTLLPREPLPATASRASLSSNMAKISSPTETERCIESLIAVFQKYAGKDGYNYTLSQDRVPKLHEYRTSCLHKEPEGPLVSLTA

SEQ ID NO: 829346 - protein, 105 aa, Homo sapiens; identical to SEQ ID NO: 829332

SEQ ID NO: 829347 - protein, 105 aa, Homo sapiens; identical to SEQ ID NO: 829332

SEQ ID NO: 829348 - protein, 105 aa, Homo sapiens; identical to SEQ ID NO: 829332

SEQ ID NO: 829349 - protein, 116 aa, Homo sapiens
EAPKAMAADLLRSFWHSLEDPVVHSFQAEATTASSLPLCQSCLNRWMVGTDGSSMLAMRYRFYDNRTMTVFKSIKIHPPVLGIIMCPRLYFNSDLDPVVGLIQDLYLSFKACLLSN

SEQ ID NO: 829350 - protein, 187 aa, Homo sapiens
METSPTNMKNVANTVTISHILPHIKIIHTEEKPDKCEECNKVFNWSSTHTKYKRIHTEDKFYKYEECDKSFKNISTLITHKIIYVVEKFYKCEECGKVFFFFLKWSLTLSPKLECNGAISVHCNLRLLGSSDSLASTSQAAGIAGACHHAQLIFVFLVETGFHHFDQAGFELLTSSDPPALASQSAP

SEQ ID NO: 829351 - protein, 213 aa, Homo sapiens
MAAAADERSPEDGEDEEEEEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEEEIQMNDSSNLSCEQEKPMHLEIEDSGPLIDIPSETEGSVFMETQMLP

SEQ ID NO: 829352 - protein, 298 aa, Homo sapiens
MAAAADERSPEDGEDEEEEEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEEEIQMNDSSNLSCEQEKPMHLEIEDSGPLIDIPSETEGSVYGNSNVCLKTSLKKGSLNTAEPLSGPNKLGGLHTHPTHAPRTTRGAPNPVKKRRQTDTPQNYTRVKTHSRSILPRHRITTAPRDTARNHARRR

SEQ ID NO: 829353 - protein, 135 aa, Homo sapiens
LHVGTGALGARSHPPAGSRHLEFWQKQFARRGAERQEPNKLLRLGAEARTQDGGSGRAWPVTRRRGAAGPWRRRRTSGVQRTEKTRKRRSSWFWWNYQELLIQTSSQNVKINARFWALTLRAHSASDTNVRYRTR

SEQ ID NO: 829354 - protein, 211 aa, Homo sapiens
THASGPTRPDGEDEEEEEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEEEIQMNDSSNLSCEQEKPMHLEIEDSGPLIDIPSETEGSVFMETQMLP

SEQ ID NO: 829355 - protein, 195 aa, Homo sapiens
MAAAADERSPEDGEDEEEEEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEEEIQMNDSSNLSCEQEKPMHLEIMETQMLP

SEQ ID NO: 829356 - protein, 213 aa, Homo sapiens
VYLIDVKFNGTHIPGSPFKIRVGSLGMEGTQAWCLLTEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEEEIQMNDSSNLSCEQEKPMHLEIMETQMLP

SEQ ID NO: 829357 - protein, 213 aa, Homo sapiens; identical to SEQ ID NO: 829351

SEQ ID NO: 829358 - protein, 213 aa, Homo sapiens; identical to SEQ ID NO: 829351

SEQ ID NO: 829359 - protein, 106 aa, Homo sapiens
MAAAADERSPEDGEDEEEEEQLVLVELSGIIDSDFLSKCENKCKVLGIDTERPILQVDSCVFAGEYEDTLGTCVIFEENVEHVIQKGNIKTRAKKLINKPPSHTNL

SEQ ID NO: 829360 - protein, 232 aa, Homo sapiens
PLLLTGFLLLGARSRAAWDLSPNRHPVLGMGSTGKLPEEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEEEIQMNDSSNLSCEQEKPMHLEIEDSGPLIDIPSETEGSVFMETQMLP

SEQ ID NO: 829361 - protein, 213 aa, Homo sapiens; identical to SEQ ID NO: 829351

SEQ ID NO: 829362 - protein, 102 aa, Homo sapiens
CLFLIPSKLGGVEWLQIKDNDFSYRPNMICNFLHENEDEEVVASAPDKSLELEEEEIQMNDSSNLSCEQEKPMHLEIEDSGPLIDIPSETEGSVFMETQMLP

SEQ ID NO: 829363 - protein, 753 aa, Homo sapiens
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 829364 - protein, 185 aa, Homo sapiens
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPVR

SEQ ID NO: 829365 - protein, 753 aa, Homo sapiens; identical to SEQ ID NO: 829363

SEQ ID NO: 829366 - protein, 117 aa, Homo sapiens
MATAATEEPFPFHGLLPKKETGAASFLCRYPEYDGRGVLIAVLDTGVDPGAPGMQVTTDGKPKIVDIIDTTGSGDVNTATEVEPKDGEIVGLSGRVLKVEVQWHNLGSPRPLLPVFK

SEQ ID NO: 829367 - protein, 999 aa, Homo sapiens
MFCHFPTFVSLGAHGTHVASIAAGHFPEEPERNGVAPGAQILSIKIGDTRLSTMETGTGLIRAMIEVINHKCDLVNYSYGEATHWPNSGRICEVINEAVWKHNIIYVSSAGNNGPCLSTVGCPGGTTSSVIGVGAYVSPDMMVAEYSLREKLPANQYTWSSRGPSADGALGVSISAPGGAIASVPNWTLRGTQLMNGTSMSSPNACGGIALILSGLKANNIDYTVHSVRRALENTAVKADNIEVFAQGHGIIQVDKAYDYLVQNTSFANKLGFTVTVGNNRGIYLRDPVQVAAPSDHGVGIEPVFPENTENSEKISLQLHLALTSNSSWVQCPSHLELMNQCRHINIRVDPRGLREGLHYTEVCGYDIASPNAGPLFRVPITAVIAAKVNESSHYDLAFTDVHFKPGQIRRHFIEVPEGATWAEVTVCSCSSEVSAKFVLHAVQLVKQRAYRSHEFYKFCSLPEKGTLTEAFPVLGGKAIEFCIARWWASLSDVNIDYTISFHGIVCTAPQLNIHASEGINRFDVQSSLKYEDLAPCITLKNWVQTLRPVSAKTKPLGSRDVLPNNRQLYEMVLTYNFHQPKSGEVTPSCPLLCELLYESEFDSQLWIIFDQNKRQMGSGDAYPHQYSLKLEKGDYTIRLQIRHEQISDLERLKDLPFIVSHRLSNTLSLDIHENHSFALLGKKKSSNLTLPPKYNQPFFVTSLPDDKIPKGAGPGCYLAGSLTLSKTELGKKADVIPVHYYLIPPPTKTKNGSKDKEKDSEKEKDLKEEFTEALRDLKIQWMTKLDSSDIYNELKETYPNYLPLYVARLHQLDAEKERMKRLNEIVDAANAVISHIDQTALAVYIAMKTDPRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 829368 - protein, 661 aa, Homo sapiens
MNQCRHINIRVDPRGLREGLHYTEVCGYDIASPNAGPLFRVPITAVIAAKVNESSHYDLAFTDVHFKPGQIRRHFIEVPEGATWAEVTVCSCSSEVSAKFVLHAVQLVKQRAYRSHEFYKFCSLPEKGTLTEAFPVLGGKAIEFCIARWWASLSDVNIDYTISFHGIVCTAPQLNIHASEGINRFDVQSSLKYEDLAPCITLKNWVQTLRPVSAKTKPLGSRDVLPNNRQLYEMVLTYNFHQPKSGEVTPSCPLLCELLYESEFDSQLWIIFDQNKRQMGSGDAYPHQYSLKLEKGDYTIRLQIRHEQISDLERLKDLPFIVSHRLSNTLSLDIHENHSFALLGKKKSSNLTLPPKYNQPFFVTSLPDDKIPKGAGPGCYLAGSLTLSKTELGKKADVIPVHYYLIPPPTKTKNGSKDKEKDSEKEKDLKEEFTEALRDLKIQWMTKLDSSDIYNELKETYPNYLPLYVARLHQLDAEKERMKRLNEIVDAANAVISHIDQTALAVYIAMKTDPRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 829369 - protein, 397 aa, Homo sapiens
NLMGLVRTKKEELAGSDSLILPATYSLKLEKGDYTIRLQIRHEQISDLERLKDLPFIVSHRLSNTLSLDIHENHSFALLGKKKSSNLTLPPKYNQPFFVTSLPDDKIPKGAGPGCYLAGSLTLSKTELGKKADVIPVHYYLIPPPTKTKNGSKDKEKDSEKEKDLKEEFTEALRDLKIQWMTKLDSSDIYNELKETYPNYLPLYVARLHQLDAEKERMKRLNEIVDAANAVISHIDQTALAVYIAMKTDPRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 829370 - protein, 217 aa, Homo sapiens
MTKLDSSDIYNELKETYPNYLPLYVARLHQLDAEKERMKRLNEIVDAANAVISHIDQTALAVYIAMKTDPRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 829371 - protein, 259 aa, Homo sapiens
MTKLDSSDIYNELKETYPNYLPLYVARLHQLDAEKERMKRLNEIVDAANAVISHIDQTALAVYIAMKTDPRPDAATIKKLPSDFCIIPALLWAARIHQAAFAESALQTLAERRMKGVLRHSDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 829372 - protein, 159 aa, Homo sapiens
IFVVTGYDLALIRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 829373 - protein, 107 aa, Homo sapiens
LLISEIFFNLLYSDMDKQKSTLVDALCRKGCALADHLLHTQAQDGAISTDAEGKEEEGESPLDSLAETFWETTKWTDLFDNKVTFLLLVSAKFLGLPHRPLLCPIAG

SEQ ID NO: 829374 - protein, 217 aa, Homo sapiens; identical to SEQ ID NO: 829370

SEQ ID NO: 829375 - protein, 288 aa, Homo sapiens
GSWVLKELAQAIDLFPFPSLMFHDVIPVHYYLIPPPTKTKNGSKDKEKDSEKEKDLKEEFTEALRDLKIQWMTKLDSSDIYNELKETYPNYLPLYVARLHQLDAEKERMKRLNEIVDAANAVISHIDQTALAVYIAMKTDPRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 829376 - protein, 386 aa, Homo sapiens
VTGSLVCTPPLLGFFWQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 829377 - protein, 537 aa, Homo sapiens
MPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 829378 - protein, 664 aa, Homo sapiens
MDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 829379 - protein, 379 aa, Homo sapiens
MPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKETLSSHSVGMGSSRRQTLLLSGLAAGCPLLLEGHHIDAKLSVDAQLVECTTAQNSWTQVSLPSPWDYRFLNDPAAWQRWCLLIWLR

SEQ ID NO: 829380 - protein, 67 aa, Homo sapiens
AQPANAWTLAERLSAANPVEPPDFCHQKPSVSAGLRSQAAKLTEISTQLQKMNASPFYAFCCGGREC

SEQ ID NO: 829381 - protein, 67 aa, Homo sapiens; identical to SEQ ID NO: 829380

SEQ ID NO: 829382 - protein, 152 aa, Homo sapiens
MSTPARRRLMRDFKRLQEDPPVGVSGAPSENNIMQWNAVIFGPEGTPFEDGTFKLVIEFSEEYPNKPPTVRFLSKMFHPNVYADGSICLDILQNRWSPTYDVSSILTSIQSLLDEPNPNSPANSQAAQLYQENKREYEKRVSAIVEQSWNDS

SEQ ID NO: 829383 - protein, 152 aa, Homo sapiens; identical to SEQ ID NO: 829382

SEQ ID NO: 829384 - protein, 152 aa, Homo sapiens; identical to SEQ ID NO: 829382

SEQ ID NO: 829385 - protein, 152 aa, Homo sapiens; identical to SEQ ID NO: 829382

SEQ ID NO: 829386 - protein, 152 aa, Homo sapiens; identical to SEQ ID NO: 829382

SEQ ID NO: 829387 - protein, 99 aa, Homo sapiens
HEDSSENSITSLKVPTVRFLSKMFHPNVYADGSICLDILQNRWSPTYDVSSILTSIQSLLDEPNPNSPANSQAAQLYQENKREYEKRVSAIVEQSWNDS

SEQ ID NO: 829388 - protein, 122 aa, Homo sapiens
MSTPARRRLMRDFKRLQEDPPVGVSGAPSENNIMQWNAVIFGPEGTPFEDVYADGSICLDILQNRWSPTYDVSSILTSIQSLLDEPNPNSPANSQAAQLYQENKREYEKRVSAIVEQSWNDS

SEQ ID NO: 829389 - protein, 152 aa, Homo sapiens; identical to SEQ ID NO: 829382

SEQ ID NO: 829390 - protein, 152 aa, Homo sapiens; identical to SEQ ID NO: 829382

SEQ ID NO: 829391 - protein, 152 aa, Homo sapiens; identical to SEQ ID NO: 829382

SEQ ID NO: 829392 - protein, 167 aa, Homo sapiens
TQLRGELLTQGQLRSMSTPARRRLMRDFKRLQEDPPVGVSGAPSENNIMQWNAVIFGPEGTPFEDGTFKLVIEFSEEYPNKPPTVRFLSKMFHPNVYADGSICLDILQNRWSPTYDVSSILTSIQSLLDEPNPNSPANSQAAQLYQENKREYEKRVSAIVEQSWNDS

SEQ ID NO: 829393 - protein, 107 aa, Homo sapiens
MQLYLGTFKLVIEFSEEYPNKPPTVRFLSKMFHPNVYADGSICLDILQNRWSPTYDVSSILTSIQSLLDEPNPNSPANSQAAQLYQENKREYEKRVSAIVEQSWNDS

SEQ ID NO: 829394 - protein, 139 aa, Homo sapiens
MSTPARRRLMRDFKRLQEDPPVGVSGAPSENNIMQWNAVIFGPEGTPFEDGTFKLVIEFSEEYPNKPPTVRFLSKMFHPNVYADGSICLDILQNRWSPTYDVSSILTSIQCLALLPRLECNGTILAHRNLCLPGSISAG

SEQ ID NO: 829395 - protein, 152 aa, Homo sapiens; identical to SEQ ID NO: 829382

SEQ ID NO: 829396 - protein, 86 aa, Homo sapiens
AQHLQGRPAPVPGPILSGQKPETRSWNWILHKLDHPSESRIAPGTHGEHSLHGCRINNGARKVEMDAYTWGIVSGRSVCVIKTCST

SEQ ID NO: 829397 - protein, 127 aa, Homo sapiens
RGVRRGIAASAVGGEPGGESLCFLSPQAQHLQGRPAPVPGPILSGQKPETRSWNWILHKLDHVSWARPEVEATAAGGGHLMILKDPINRGYKPGAGHQGGLSLWPDLVCLHQEGPAFHLQENMAAAE

SEQ ID NO: 829398 - protein, 366 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPSSPFQVTAGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 829399 - protein, 579 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 829400 - protein, 289 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGVSNLIEKSLIYLIATTFSVSDTLGLV

SEQ ID NO: 829401 - protein, 549 aa, Homo sapiens
AQRHIGADLPLLSVGGQWCWPRSVMAGVVHVSLAAHCGACPWGRGRLRKGRAACKSAAQRHIGADLPLLSVGGQWCWPRSVMAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 829402 - protein, 468 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 829403 - protein, 447 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 829404 - protein, 270 aa, Homo sapiens
MRSPRIAQKIKGPPRSRVRRIAAGTKPERGAALPVVAAVPGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829405 - protein, 150 aa, Homo sapiens
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPSSAYPM

SEQ ID NO: 829406 - protein, 270 aa, Homo sapiens; identical to SEQ ID NO: 829404

SEQ ID NO: 829407 - protein, 270 aa, Homo sapiens; identical to SEQ ID NO: 829404

SEQ ID NO: 829408 - protein, 270 aa, Homo sapiens; identical to SEQ ID NO: 829404

SEQ ID NO: 829409 - protein, 270 aa, Homo sapiens; identical to SEQ ID NO: 829404

SEQ ID NO: 829410 - protein, 270 aa, Homo sapiens; identical to SEQ ID NO: 829404

SEQ ID NO: 829411 - protein, 270 aa, Homo sapiens; identical to SEQ ID NO: 829404

SEQ ID NO: 829412 - protein, 270 aa, Homo sapiens; identical to SEQ ID NO: 829404

SEQ ID NO: 829413 - protein, 398 aa, Homo sapiens
RQAEGKVEDDDPGTGLKRKSALGAAGWAHQEPGGSALEGLKRKSALGAAGWAHQEPGGSPASAAEESRRRWRRREDVSWGGIRLHPCFGGCPAGPAGRLVKPVHSSAPQCAVAWQRGLLHLPNAKTAQMRSPRIAQKIKGPPRSRVRRIAAGTKPERGAALPVVAAVPGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829414 - protein, 300 aa, Homo sapiens
HEGERGGGKQEEVAAAGRWLLHLPNAKTAQMRSPRIAQKIKGPPRSRVRRIAAGTKPERGAALPVVAAVPGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829415 - protein, 270 aa, Homo sapiens; identical to SEQ ID NO: 829404

SEQ ID NO: 829416 - protein, 159 aa, Homo sapiens
MNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829417 - protein, 276 aa, Homo sapiens
MSKVSLDKMEGAAIGRIEMHESDRRVAGHKLGSDGAGSSSDSNIDHGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829418 - protein, 232 aa, Homo sapiens
MAYEHFQTAEVSRSDHALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829419 - protein, 270 aa, Homo sapiens; identical to SEQ ID NO: 829404

SEQ ID NO: 829420 - protein, 147 aa, Homo sapiens
MGSKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829421 - protein, 117 aa, Homo sapiens
MIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829422 - protein, 104 aa, Homo sapiens
DAWVGRVGRPTRPDEAEKALKHMDGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829423 - protein, 265 aa, Homo sapiens
MRSPRIAQKIKGPPRSRVRRIAAGTKPERGAALPVVAAVPGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRKTVSSILP

SEQ ID NO: 829424 - protein, 281 aa, Homo sapiens
MRSPRIAQKIKGPPRSRVRRIAAGTKPERGAALPVVAAVPGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRKPRVHRIELLVADSITITGNIMFP

SEQ ID NO: 829425 - protein, 272 aa, Homo sapiens
MRSPRIAQKIKGPPRSRVRRIAAGTKPERGAALPVVAAVPGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGDKLMAGDHWHDVKARARHPRRSASQGNVNNASGRSPHDKKSRTEAVPARNTARATTERQTLKREPAIPHSCCRTETAERNTS

SEQ ID NO: 829426 - protein, 158 aa, Homo sapiens
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEQGEEKAEPIS

SEQ ID NO: 829427 - protein, 210 aa, Homo sapiens
RQAEGKVEDDDPGTGLKRKSALGAAGWAHQEPGGSALEGLKRKLRWELQAGPIRSLGARRPRRLRKAGGGGGGGKMAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEQGEEKAEPIS

SEQ ID NO: 829428 - protein, 101 aa, Homo sapiens
LCSCVLCMRVCCVCMCVLCAVFMCVLCVRVLCACVCCVCVCAVCAVFVCAVFAVCAVCACVCCVFVCVLCASVCAVCACVRVCVLCVCVCAVCSSVCCSVL

SEQ ID NO: 829429 - protein, 167 aa, Homo sapiens
VVGAAADGRAPVLRPLGGGPARPAGLRPAGSAASALGALPPGRRPKPPTPGPALEALAARRLDGGVVSERGRVAARSACRAGVGGRGVSLWDAVEGRPIPPSESLIQTCTRERFPDSRVQLSALGRGDTAHYGPSTVAELSLMGYPRGADTGRLSLLEEKRGVGFLS

SEQ ID NO: 829430 - protein, 244 aa, Homo sapiens
MRSPRIAQKIKGPPRSRVRRIAAGTKPERGAALPVVAAVPGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGANWWPENKWQRAGGHWAKHPKENSPPGKWHHRYERSPGKRRAPGEPGRNKKPRT

SEQ ID NO: 829431 - protein, 114 aa, Homo sapiens
MDLSGVKKKSLLGVKENNKKSSTRAPSPTKRKDRSDEKSKDRSKDKGATKESSEKDRGRDKTRKRRSASSGSSSTRWGGLAWSLERTCATATPPLPTDGSVFLIIYKENTSSDC

SEQ ID NO: 829432 - protein, 270 aa, Homo sapiens; identical to SEQ ID NO: 829404

SEQ ID NO: 829433 - protein, 270 aa, Homo sapiens; identical to SEQ ID NO: 829404

SEQ ID NO: 829434 - protein, 270 aa, Homo sapiens; identical to SEQ ID NO: 829404

SEQ ID NO: 829435 - protein, 270 aa, Homo sapiens; identical to SEQ ID NO: 829404

SEQ ID NO: 829436 - protein, 270 aa, Homo sapiens; identical to SEQ ID NO: 829404

SEQ ID NO: 829437 - protein, 270 aa, Homo sapiens; identical to SEQ ID NO: 829404

SEQ ID NO: 829438 - protein, 348 aa, Homo sapiens
VVGGRCGRKGACASSARRWPSQARGTQTSGERGLRPWGPPAGPETQAPNARPCPGSARGPAPGRGSWLLHLPNAKTAQMRSPRIAQKIKGPPRSRVRRIAAGTKPERGAALPVVAAVPGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829439 - protein, 270 aa, Homo sapiens; identical to SEQ ID NO: 829404

SEQ ID NO: 829440 - protein, 159 aa, Homo sapiens; identical to SEQ ID NO: 829416

SEQ ID NO: 829441 - protein, 239 aa, Homo sapiens
MRSPRIAQKIKGPPRSRVRRIAAGTKPERGAALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 829442 - protein, 159 aa, Homo sapiens; identical to SEQ ID NO: 829416

SEQ ID NO: 829443 - protein, 270 aa, Homo sapiens; identical to SEQ ID NO: 829404

SEQ ID NO: 829444 - protein, 245 aa, Homo sapiens
MRSPRIAQKIKGPPRSRVRRIAAGTKPERGAALPVVAAVPGLGPARLPAQAPAPALAQAVAPALPQHPAAQEAPAPPAAPALAALLALQVLLGADTTTGGAPAPNPNHLKEMNKERKRRSPSPKPTKVHIGRLTRNVTKDHIMEIFSTYGKIKMIDMPVERMHPHLSKGYAYVEFENPDEAEKALKHMDGGPAPRGAGPPCAGDHGPRAAAATGAAPAPTPPDKQATEALAPVTYTPPSSVLSLF

SEQ ID NO: 829445 - protein, 270 aa, Homo sapiens; identical to SEQ ID NO: 829404

SEQ ID NO: 829446 - protein, 265 aa, Homo sapiens; identical to SEQ ID NO: 829423

SEQ ID NO: 829447 - protein, 244 aa, Homo sapiens; identical to SEQ ID NO: 829430

SEQ ID NO: 829448 - protein, 158 aa, Homo sapiens; identical to SEQ ID NO: 829426

SEQ ID NO: 829449 - protein, 167 aa, Homo sapiens; identical to SEQ ID NO: 829429

SEQ ID NO: 829450 - protein, 114 aa, Homo sapiens; identical to SEQ ID NO: 829431

SEQ ID NO: 829451 - protein, 411 aa, Homo sapiens
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQVRETQALILAPTRELAVQIQKGLLALGDYMNVQCHACIGGTNVGEDIRKLDYGQHVVAGTPGRVFDMIRRRSLRTRAIKMLVLDEADEMLNKGFKEQIYDVYRYLPPATQVVLISATLPHEILEMTNKFMTDPIRILVKRDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 829452 - protein, 411 aa, Homo sapiens; identical to SEQ ID NO: 829451

SEQ ID NO: 829453 - protein, 411 aa, Homo sapiens; identical to SEQ ID NO: 829451

SEQ ID NO: 829454 - protein, 411 aa, Homo sapiens; identical to SEQ ID NO: 829451

SEQ ID NO: 829455 - protein, 411 aa, Homo sapiens; identical to SEQ ID NO: 829451

SEQ ID NO: 829456 - protein, 411 aa, Homo sapiens; identical to SEQ ID NO: 829451

SEQ ID NO: 829457 - protein, 301 aa, Homo sapiens
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQVRETQALILAPTRELAVQIQKGLLALGDYMNVQCHACIGGTNVGEDIRKLDYGQHVVAGTPGRVFDMIRRRSLRTRAIKMLVLDEADEMLNKGFKEQIYDVYRYLPPATQVVLISATLPHEILEMTNKFMTDPIRILVKRDELTLEGIKQFFVAVEREEWKFDTLCDLYDTLTITQAVIFCNTKRKMETCPRKSGSPS

SEQ ID NO: 829458 - protein, 213 aa, Homo sapiens
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQVRETQALILAPTRELAVQIQKGLLALGDYMNVQCHACIGGTNVGEDIRKLDYGQHVVAGTPGRVFDMIRRRSLRTRAIVSKSRFTMYTGTCLQPHRWFSSVPRCHTRFWR

SEQ ID NO: 829459 - protein, 279 aa, Homo sapiens
MNVQCHACIGGTNVGEDIRKLDYGQHVVAGTPGRVFDMIRRRSLRTRAIKMLVLDEADEMLNKGFKEQIYDVYRYLPPATQVVLISATLPHEILEMTNKFMTDPIRILVKRDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 829460 - protein, 243 aa, Homo sapiens [sequence omitted]

SEQ ID NO: 829461 - protein, 228 aa, Homo sapiens
MEACVTEVVIGWRTGLGLLGLHQISRCDLFHQGLPGSWLGPPSSPRRKDEYVTGFVFAFSDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 829462 - protein, 182 aa, Homo sapiens
NPLPSPNPPHLVKRDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 829463 - protein, 411 aa, Homo sapiens; identical to SEQ ID NO: 829451

SEQ ID NO: 829464 - protein, 411 aa, Homo sapiens; identical to SEQ ID NO: 829451

SEQ ID NO: 829465 - protein, 411 aa, Homo sapiens; identical to SEQ ID NO: 829451

SEQ ID NO: 829466 - protein, 279 aa, Homo sapiens; identical to SEQ ID NO: 829459

SEQ ID NO: 829467 - protein, 390 aa, Homo sapiens
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQGLLALGDYMNVQCHACIGGTNVGEDIRKLDYGQHVVAGTPGRVFDMIRRRSLRTRAIKMLVLDEADEMLNKGFKEQIYDVYRYLPPATQVVLISATLPHEILEMTNKFMTDPIRILVKRDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 829468 - protein, 223 aa, Homo sapiens
PTRRPRVRFKEQIYDVYRYLPPATQVVLISATLPHEILEMTNKFMTDPIRILVKRDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 829469 - protein, 257 aa, Homo sapiens
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQVRETQALILAPTRELAVQIQKGLLALGDYMNVQCHACIGGTNVGEDIRKLDYGQHVVAGTPGRVFDLIRRRSLRDTGYTKVVRMYVSNGALQGSTEQNYPYNRDRAHGNPGGTNKGTLTPKTGNAPQSRTGPTATAHSTMHSRQQRSEANTENT

SEQ ID NO: 829470 - protein, 197 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKWYENFQRRLAQNPLFWKT

SEQ ID NO: 829471 - protein, 204 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKWYLNFTTTRQNLHTTTNICINLLYR

SEQ ID NO: 829472 - protein, 194 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKWYEAFSVSNIKAFYN

SEQ ID NO: 829473 - protein, 179 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLK

SEQ ID NO: 829474 - protein, 179 aa, Homo sapiens; identical to SEQ ID NO: 829473

SEQ ID NO: 829475 - protein, 148 aa, Homo sapiens
MGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKWYENFQRRLAQNPLFWKT

SEQ ID NO: 829476 - protein, 148 aa, Homo sapiens; identical to SEQ ID NO: 829475

SEQ ID NO: 829477 - protein, 109 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSETGSYSVFQAGVQCPHYSSL

SEQ ID NO: 829478 - protein, 156 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQVKDFLEMVTILYEKIG

SEQ ID NO: 829479 - protein, 197 aa, Homo sapiens; identical to SEQ ID NO: 829470

SEQ ID NO: 829480 - protein, 194 aa, Homo sapiens; identical to SEQ ID NO: 829472

SEQ ID NO: 829481 - protein, 192 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKCILEMGGCLGRVC

SEQ ID NO: 829482 - protein, 106 aa, Homo sapiens [sequence omitted]

SEQ ID NO: 829483 - protein, 148 aa, Homo sapiens; identical to SEQ ID NO: 829475

SEQ ID NO: 829484 - protein, 183 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPFTQKMLDNFYNFASSFAVSQAQMTPSPSEMFIPANVVLKWYENFQRRLAQNPLFWKT

SEQ ID NO: 829485 - protein, 887 aa, Homo sapiens
GAYHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 829486 - protein, 887 aa, Homo sapiens; identical to SEQ ID NO: 829485

SEQ ID NO: 829487 - protein, 244 aa, Homo sapiens [sequence omitted]

SEQ ID NO: 829488 - protein, 208 aa, Homo sapiens
MSSKVSRDTLYEAVREVLHGNQRKRRKFLETVELQISLKNYDPQKDKRFSDPVAYRLVSDVCPDRSATCTVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 829489 - protein, 632 aa, Homo sapiens
GAYHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQVRSLFIYMYVYLL

SEQ ID NO: 829490 - protein, 449 aa, Homo sapiens
LASSKLPLHPPLFLRKTQDLGDGPGIWKDLKTMGSVSLSIFFITLLVLGRQHMHIITVRFSTSFMAQHTNIHTHKQRAGSISSTHGQHTCTPALLARQQRCYPSDTWTEATSLAPGSHAQQCRQLIPTQLLMHMAVPAIHSISTSTSPGISQQHIFSSPAHTAQMQRRAGASGTMPYRSILSNGSIAIDIGTYKEWPSLSISHKATTTSQAGKISTHKACNSNPIEAQGKHHQWGKDPHKGSLADGPGGTNRTTRTPPSHQEARPLQDETQTTEWRTHFRAATHMGQWQESQDLSGTRTKISGDNAMEHVTKIQQTTRPIVPVSPTGTAYHPRSAPPQAAGSNIHSRPQWEETAPGGTIEDLGDGAADTLGRTKPLNQQSDSPPHADRRTTSQEESARPTHDGVPQTGTAPPTTQERTPAQTLESPEDNRNSHHAHTSHREKRQDKSIN

SEQ ID NO: 829491 - protein, 869 aa, Homo sapiens
GAYHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 829492 - protein, 887 aa, Homo sapiens; identical to SEQ ID NO: 829485

SEQ ID NO: 829493 - protein, 285 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTGMAFFKMREMFFEDHIDDAKYCGHLYGLGSGSSYVQNGTGNAYEEEANKQS

SEQ ID NO: 829494 - protein, 285 aa, Homo sapiens; identical to SEQ ID NO: 829493

SEQ ID NO: 829495 - protein, 244 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTGMAFFKMREV

SEQ ID NO: 829496 - protein, 285 aa, Homo sapiens; identical to SEQ ID NO: 829493

SEQ ID NO: 829497 - protein, 285 aa, Homo sapiens; identical to SEQ ID NO: 829493

SEQ ID NO: 829498 - protein, 285 aa, Homo sapiens; identical to SEQ ID NO: 829493

SEQ ID NO: 829499 - protein, 244 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTAYEEEANKQS

SEQ ID NO: 829500 - protein, 307 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTLGVVAHACNPSTLGGRGGRITTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTGMAFFKMREMFFEDHIDDAKYCGHLYGLGSGSSYVQNGTGNAYEEEANKQS

SEQ ID NO: 829501 - protein, 248 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKMFFEDHIDDAKYCGHLYGLGSGSSYVQNGTGNAYEEEANKQS

SEQ ID NO: 829502 - protein, 244 aa, Homo sapiens; identical to SEQ ID NO: 829495

SEQ ID NO: 829503 - protein, 295 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTGMAFFKMREMFFEDHIDDAKYCGHLYGLGSGSSYVQNGTGNARRGFSQSRQEIVRASAMSG

SEQ ID NO: 829504 - protein, 111 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTRKWEITV

SEQ ID NO: 829505 - protein, 285 aa, Homo sapiens; identical to SEQ ID NO: 829493

SEQ ID NO: 829506 - protein, 285 aa, Homo sapiens; identical to SEQ ID NO: 829493

SEQ ID NO: 829507 - protein, 285 aa, Homo sapiens; identical to SEQ ID NO: 829493

SEQ ID NO: 829508 - protein, 285 aa, Homo sapiens; identical to SEQ ID NO: 829493

SEQ ID NO: 829509 - protein, 285 aa, Homo sapiens; identical to SEQ ID NO: 829493

SEQ ID NO: 829510 - protein, 204 aa, Homo sapiens
MNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTGMAFFKMREMFFEDHIDDAKYCGHLYGLGSGSSYVQNGTGNAYEEEANKQS

SEQ ID NO: 829511 - protein, 307 aa, Homo sapiens; identical to SEQ ID NO: 829500

SEQ ID NO: 829512 - protein, 107 aa, Homo sapiens
LQEVAEQLEIFAALHEVLHIINDRKNLKGGLQEVAEQLELERIGPQHQAGSDSLLTGMAFFKMREMFFEDHIDDAKYCGHLYGLGSGSSYVQNGTGNAYEEEANKQS

SEQ ID NO: 829513 - protein, 228 aa, Homo sapiens [sequence omitted]

SEQ ID NO: 829514 - protein, 141 aa, Homo sapiens
MNARGLGSELKDSIPVTELSASGPFESHDLLRKGFSCVKNELLPSHPLELSEKNFQLNQDKMNFSTLRNIQGLFAPLKLQMEFKAVQQVQRLPFLSSSNLSLDVLRGNDETIGFEDILNDPSQSEVMGEPHLMVEYKLGLL

SEQ ID NO: 829515 - protein, 159 aa, Homo sapiens
GLQEFGTRGERLFAELRKMNARGLGSELKDSIPVTELSASGPFESHDLLRKGFSCVKNELLPSHPLELSEKNFQLNQDKMNFSTLRNIQGLFAPLKLQMEFKAVQQVQRLPFLSSSNLSLDVLRGNDETIGFEDILNDPSQSEVMGEPHLMVEYKLGLL

SEQ ID NO: 829516 - protein, 141 aa, Homo sapiens; identical to SEQ ID NO: 829514

SEQ ID NO: 829517 - protein, 141 aa, Homo sapiens; identical to SEQ ID NO: 829514

SEQ ID NO: 829518 - protein, 141 aa, Homo sapiens; identical to SEQ ID NO: 829514

SEQ ID NO: 829519 - protein, 141 aa, Homo sapiens; identical to SEQ ID NO: 829514

SEQ ID NO: 829520 - protein, 141 aa, Homo sapiens; identical to SEQ ID NO: 829514

SEQ ID NO: 829521 - protein, 141 aa, Homo sapiens; identical to SEQ ID NO: 829514

SEQ ID NO: 829522 - protein, 159 aa, Homo sapiens; identical to SEQ ID NO: 829515

SEQ ID NO: 829523 - protein, 164 aa, Homo sapiens
MSPGAAGSTDGNGAERLFAELRKMNARGLGSELKDSIPVTELSASGPFESHDLLRKGFSCVKNELLPSHPLELSEKNFQLNQDKMNFSTLRNIQGLFAPLKLQMEFKAVQQVQRLPFLSSSNLSLDVLRGNDETIGFEDILNDPSQSEVMGEPHLMVEYKLGLL

SEQ ID NO: 829524 - protein, 141 aa, Homo sapiens; identical to SEQ ID NO: 829514

SEQ ID NO: 829525 - protein, 141 aa, Homo sapiens; identical to SEQ ID NO: 829514

SEQ ID NO: 829526 - protein, 132 aa, Homo sapiens
MNARGLGSELKDSIPVTELSASGPFESHDLLRKGFSCVKNELLPSHPLELSEKNFQLNQDKMNFSTLRNIQGLFAPLKLQMEFKAVQQVQRLPFLSSSNLSLDVFFGKKGGGRAPPFFLKKKIFGGNQWESH

SEQ ID NO: 829527 - protein, 209 aa, Homo sapiens
MKAVVQRVTRASVTVGGEQISAIGRGICVLLGISLEDTQKELEHMVRKILNLRVFEDESGKHWSKSVMDKQYEILCVSQFTLQCVLKGNKPDFHLAMPTEQAEGFYNSFLEQLRKTYRPELIKDGKFGAYMQVHIQNDGPVTIELESPAPGTATSDPKQLSKLEKQQQRKEKTRAKGPSESSKERNTPRKEDRSASSGAEGDVSSEREP

SEQ ID NO: 829528 - protein, 209 aa, Homo sapiens; identical to SEQ ID NO: 829527

SEQ ID NO: 829529 - protein, 209 aa, Homo sapiens; identical to SEQ ID NO: 829527

SEQ ID NO: 829530 - protein, 209 aa, Homo sapiens; identical to SEQ ID NO: 829527

SEQ ID NO: 829531 - protein, 209 aa, Homo sapiens; identical to SEQ ID NO: 829527

SEQ ID NO: 829532 - protein, 254 aa, Homo sapiens
MKAVVQRVTRASVTVGGEQISAIGRGICVLLGISLEDTQKELEHMVRKILNLRVFEDESGKHWSKSVMDKQYEILCVSQFTLQCVLKGNKPDFHLAMPTEQAEGFYNSFLEQLRKTYRPELIKDGKFGAYMQVHIQNDGPVTIELESPAPGTATSDPKQLSKLEKQQQRKEKTRAKGPSESSKVCARASPTERLCWFLPHLGLLLEQAGPASFVIKSTVVYSACPWRGFSNTLTLSMFFLLPGPVLKCQESNHQ

SEQ ID NO: 829533 - protein, 264 aa, Homo sapiens
RLPEDLPVDDAIFMENICSKGLHHRLVGRATWGIGPMTQVVTVNDKRPQALQSLSYGALPRATDASQPNYIETCGELWPFIWRPKQVPQFTLQCVLKGNKPDFHLAMPTEQAEGFYNSFLEQLRKTYRPELIKDGKFGAYMQVHIQNDGPVTIELESPAPGTATSDPKQLSKLEKQQQRKEKTRAKGPSESSKVCARASPTERLCWFLPHLGLLLEQAGPASFVIKSTVVYSACPWRGFSNTLTLSMFFLLPGPVLKCQESNHQ

SEQ ID NO: 829534 - protein, 115 aa, Homo sapiens
EIHHCCNVVFILIPAFPRVHVYGALLSTVAGGYSTSPLPRPAFEFQRTCPVQSQVLPLGFPSLGQVPWRPPAPGWQQSNGPGLAGSPIPNGYLNWVWSQVWIDVPPKVCCKSPFF

SEQ ID NO: 829535 - protein, 527 aa, Homo sapiens
GWAIARPRVGVADVGWVAADRVGPASWARFRVSPPEGAGCGAALRVARPDAARRRPTRPSRRHEGRGAARHPGQRHRSVGRGRAREEPPLTPATGCLAWGVFLRHPWGRCGPSASLVPFASSVRAAASPQGRLRGSAAAGEPPARARPAPARPWLPALGRGCRTSAPHSQHLCPACGMAEPRSISVVRSSGSVDEPRLEHFRSRHSSLFTAYFKCSIFAHFYVFQFLWGLTQDEMHRCGELLLGLSFDSCVHVRDWSLGWMRGAPCPGRPSPSPAELCAEGSGSKEFKMKNISLFLVDQATRPLVITQHFRLGWASEVQMISVDKVVVLRNHVGGEQISAIGRGICVLLGISLEDTQKELEHMVRKILNLRVFEDESGKHWSKSVMDKQYEILCVSQFTLQCVLKGNKPDFHLAMPTEQAEGFYNSFLEQLRKTYRPELIKDGKFGAYMQVHIQNDGPVTIELESPAPGTATSDPKQLSKLEKQQQRKEKTRAKGPSESSKERNTPRKEDRSASSGAEGDVSSEREP

SEQ ID NO: 829536 - protein, 105 aa, Homo sapiens
MTYFQREQDMEAAAEPTDCCFAWCIFCRRTRFCCQSSKNSSRGKKRPELRDLLNQARKETLPEKKTAVPAAGLRATCPLNGSRSSGGRIQCVIIGQNWILKNSRC

SEQ ID NO: 829537 - protein, 209 aa, Homo sapiens; identical to SEQ ID NO: 829527

SEQ ID NO: 829538 - protein, 188 aa, Homo sapiens
MKAVVQRVTRASVTVGGEQISAIGRGICVLLGISLEDTQKELEHMVRKILNLRVFEDESGKHWSKSVMDKQYEILCVSQFTLQCVLKGNKPDFHLAMPTEQAEGFYNSFLEQLRKTYRPELIKDGKFGAYMQVHIQNDGPVTIELESPAPGTATSDPKQARCRGAHLPLGGSRAMALDWPVHPFRMVT

SEQ ID NO: 829539 - protein, 102 aa, Homo sapiens
MLVIDPDKRISVDEALRHPYITVWYDPAEAEAPPPQIYDAQLEEREHAIEEWKELIYKEVMDWEERSKNGVVKDQPSALLQGPLPTPSPCLKHGAGAASTRI

SEQ ID NO: 829540 - protein, 424 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 829541 - protein, 424 aa, Homo sapiens; identical to SEQ ID NO: 829540

SEQ ID NO: 829542 - protein, 424 aa, Homo sapiens; identical to SEQ ID NO: 829540

SEQ ID NO: 829543 - protein, 424 aa, Homo sapiens; identical to SEQ ID NO: 829540

SEQ ID NO: 829544 - protein, 424 aa, Homo sapiens; identical to SEQ ID NO: 829540

SEQ ID NO: 829545 - protein, 210 aa, Homo sapiens
MGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 829546 - protein, 317 aa, Homo sapiens
MELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 829547 - protein, 378 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSG

SEQ ID NO: 829548 - protein, 302 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKSKISFFSYTCVL

SEQ ID NO: 829549 - protein, 424 aa, Homo sapiens; identical to SEQ ID NO: 829540

SEQ ID NO: 829550 - protein, 424 aa, Homo sapiens; identical to SEQ ID NO: 829540

SEQ ID NO: 829551 - protein, 424 aa, Homo sapiens; identical to SEQ ID NO: 829540

SEQ ID NO: 829552 - protein, 424 aa, Homo sapiens; identical to SEQ ID NO: 829540

SEQ ID NO: 829553 - protein, 504 aa, Homo sapiens
MSDSKCDSQFYSVQVADSTFTVLKRYQQLKPIGSGAQGIVWRHHCSALPFIGRMRPVSVIVTPWINQEGMLCEGLGWPSLPWCLTSTVCPAQNVRIVSLTLNVSLLHGKRSAAAASRASSSAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 829554 - protein, 124 aa, Homo sapiens
MLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 829555 - protein, 242 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDRILPRDLGPAMLS

SEQ ID NO: 829556 - protein, 202 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDCTCGACGPAPGSWASVSLREGPAGVRKEWSLTSGMEMGIWDIYYVLGLSIK

SEQ ID NO: 829557 - protein, 339 aa, Homo sapiens
LTLNAACPLRLAVLAAMAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVKLSSLNLDDHAKKKLIKLVGERYCKTTDVLTIKTDRCPLRRQNYDYAVYLLTVLYHESWNTEEWEKSKTEADMEEYIWENSSSERNILETLLQMKAAEKNMEINKEELLGTKEIEEYKKSVVSLKNEEENENSISQYKESVKRLLNVT

SEQ ID NO: 829558 - protein, 192 aa, Homo sapiens
LTLNAACPLRLAVLAAMAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLREM

SEQ ID NO: 829559 - protein, 339 aa, Homo sapiens; identical to SEQ ID NO: 829557

SEQ ID NO: 829560 - protein, 210 aa, Homo sapiens
LTLNAACPLRLAVLAAMAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVPFKEAELRLCSVSTNSVIP

SEQ ID NO: 829561 - protein, 339 aa, Homo sapiens; identical to SEQ ID NO: 829557

SEQ ID NO: 829562 - protein, 358 aa, Homo sapiens
LKGAILTTMLALNFFRHSTVSCLCIMDATVEVGRPMAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVKLSSLNLDDHAKKKLIKLVGERYCKTTDVLTIKTDRCPLRRQNYDYAVYLLTVLYHESWNTEEWEKSKTEADMEEYIWENSSSERNILETLLQMKAAEKNMEINKEELLGTKEIEEYKKSVVSLKNEEENENSISQYKESVKRLLNVT

SEQ ID NO: 829563 - protein, 313 aa, Homo sapiens
ASDICVMLHLVVYGLTVPDPKSIACGKEHPEMKGPPYEREEALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVKLSSLNLDDHAKKKLIKLVGERYCKTTDVLTIKTDRCPLRRQNYDYAVYLLTVLYHESWNTEEWEKSKTEADMEEYIWENSSSERNILETLLQMKAAEKNMEINKEELLGTKEIEEYKKSVVSLKNEEENENSISQYKESVKRLLNVT

SEQ ID NO: 829564 - protein, 339 aa, Homo sapiens; identical to SEQ ID NO: 829557

SEQ ID NO: 829565 - protein, 162 aa, Homo sapiens
LKGAILTTMLALNFFRHSTVSCLCIMDATVELLADPWRPPRSQHGCLCSRGQGLCVHSPLPSTRPLRSRHLACNTEEWEKSKTEADMEEYIWENSSSERNILETLLQMKAAEKNMEINKEELLGTKEIEEYKKSVVSLKNEEENENSISQYKESVKRLLNVT

SEQ ID NO: 829566 - protein, 248 aa, Homo sapiens
LTLNAACPLRLAVLAAMAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVKLSSLNLDDHAKKKLIKLVGERYCKTTDVLTIKTDSSQMGPFTRQNTIIRVTYRVSP

SEQ ID NO: 829567 - protein, 410 aa, Homo sapiens
ERAEALALAAPGRGVRRARSCALGQRSAMRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGKWHQGVNCASRGDHCHHPLNHGFDYFYGMPFTLTNDCDPGRPPEVDAALRAQLWGYTQFLALGILTLAAGQTCGFFSVSARAVTGMAGVGCLFFISWYSSFGFVRRWNCILMRNHDVTEQPMVLEKTASLMLKEAVSYIERHKHGPFLLFLSLLHVHIPLVTTSAFLGKSQHGLYGDNVEEMDWLIASDFMSSSEVTESEAIKLMFRTMQRRCLPSMAFKKPWRGPVRLQILKRA

SEQ ID NO: 829568 - protein, 621 aa, Homo sapiens
ERAEALALAAPGRGVRRARSCALGQRSAMRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGKWHQGVNCASRGDHCHHPLNHGFDYFYGMPFTLTNDCDPGRPPEVDAALRAQLWGYTQFLALGILTLAAGQTCGFFSVSARAVTGMAGVGCLFFISWYSSFGFVRRWNCILMRNHDVTEQPMVLEKTASLMLKEAVSYIERHKHGPFLLFLSLLHVHIPLVTTSAFLGKSQHGLYGDNVEEMDWLIGKVLNAIEDNGLKNSTFTYFTSDHGGHLEARDGHSQLGGWNGIYKGGKGMGGWEGGIRVPGIFHWPGVLPAGRVIGEPTSLMDVFPTVVQLVGGEVPQDRVIDGHSLVPLLQGAEARSAHEFLFHYCGQHLHAARWHQKDSGSVWKVHYTTPQFHPEGAGACYGRGVCPCSGEGVTHHRPPLLFDLSRDPSEARPLTPDSEPLYHAVIARVGAAVSEHRQTLSPVPQQFSMSNILWKPWLQPCCGHFPFCSCHEDGDGTP

SEQ ID NO: 829569 - protein, 621 aa, Homo sapiens; identical to SEQ ID NO: 829568

SEQ ID NO: 829570 - protein, 621 aa, Homo sapiens; identical to SEQ ID NO: 829568

SEQ ID NO: 829571 - protein, 621 aa, Homo sapiens; identical to SEQ ID NO: 829568

SEQ ID NO: 829572 - protein, 621 aa, Homo sapiens; identical to SEQ ID NO: 829568

SEQ ID NO: 829573 - protein, 621 aa, Homo sapiens; identical to SEQ ID NO: 829568

SEQ ID NO: 829574 - protein, 585 aa, Homo sapiens
ERAEALALAAPGRGVRRARSCALGQRSAMRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGKWHQGVNCASRGDHCHHPLNHGFDYFYGMPFTLTNDCDPGRPPEVDAALRAQLWGYTQFLALGILTLAAGQTCGFFSVSARAVTGMAGVGCLFFISWYSSFGFVRRWNCILMRNHDVTEQPMVLEKTASLMLKEAVSYIERHKHGPFLLFLSLLHVHIPLVTTSAFLGKSQHGLYGDNVEEMDWLIGKVLNAIEDNGLKNSTFTYFTSDHGGHLEARDGHSQLGGWNGIYKGGKGMGGWEGGIRVPGIFHWPGVLPAGRVIGEPTSLMDVFPTVVQLVGGEVPQDRVIDGHSLVPLLQGAEARSAHEFLFHYCGQHLHAARWHQKDSGSVWKVHYTTPQFHPEGAGACYGRGVCPCSGEGVTHHRPPLLFDLSRDPSEARPLTPDSEPLYHAVIARGHLLAELNLKPKRR

SEQ ID NO: 829575 - protein, 209 aa, Homo sapiens
ERAEALALAAPGRGVRRARSCALGQRSAMRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGVDMWEPHIIRWLGIFVIKKIPGQAWWRTPVVPAT

SEQ ID NO: 829576 - protein, 122 aa, Homo sapiens
MPWTESGSPLSFFLSFFFETECRSVPQAGMQWHDLCSLQPPPPGFKRFSCLSLLSTQDYRHQAPATMPSYIFVVLVETGFHHVAQAGLALLTSSHPPASASQSAGITGTSHCAHVGFPFPDL

SEQ ID NO: 829577 - protein, 621 aa, Homo sapiens; identical to SEQ ID NO: 829568

SEQ ID NO: 829578 - protein, 621 aa, Homo sapiens; identical to SEQ ID NO: 829568

SEQ ID NO: 829579 - protein, 317 aa, Homo sapiens
ERAEALALAAPGRGVRRARSCALGQRSAMRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGKWHQGVNCASRGDHCHHPLNHGFDYFYGMPFTLTNDCDPGRPPEVDAALRAQLWGYTQFLALGILTLAAGQTCGFFSVSARAVTGMAGVGCLFFISWYSSFGFVRRWNCILMRNHDVTEQPMVLEKTASLMLKEAVSYIESQ

SEQ ID NO: 829580 - protein, 53 aa, Homo sapiens
MAKRQKQPIHQLRIRPLPRLSRAGLSKCRLTISTIIRFSHPIKKEIEILYNSY

SEQ ID NO: 829581 - protein, 254 aa, Homo sapiens
MRTPVNCYTPKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 829582 - protein, 242 aa, Homo sapiens
MSISHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 829583 - protein, 187 aa, Homo sapiens
IAVLEDPIRRVLRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 829584 - protein, 179 aa, Homo sapiens
PRPAALAARLAWAMPAGRRTGGRHIRHGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 829585 - protein, 284 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 829586 - protein, 284 aa, Homo sapiens; identical to SEQ ID NO: 829585

SEQ ID NO: 829587 - protein, 284 aa, Homo sapiens; identical to SEQ ID NO: 829585

SEQ ID NO: 829588 - protein, 179 aa, Homo sapiens
VSRRLYGVPRGPEGVFTQGFGNSKWFNVRNGYGFINRNDTKEDVFVHQTAIKKNNPRKYLRSYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 829589 - protein, 112 aa, Homo sapiens
MTPTRPSRHRVPFSAGQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 829590 - protein, 244 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGHQLPTQTPRKP

SEQ ID NO: 829591 - protein, 290 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRIKEMRPKVSSHLNVGTAATSITDADAQKTLNHKMAKRQKQPIHQLRIRPLPRLSRAGLSKCRLTISTIIRFSHPTRRNMKFQQ

SEQ ID NO: 829592 - protein, 284 aa, Homo sapiens; identical to SEQ ID NO: 829585

SEQ ID NO: 829593 - protein, 121 aa, Homo sapiens
RTLFSFFIAVLSRLSLARRAPAESWSISPIHILPHWSTFFSCTLVQHPPSLLPAQEGSITDADAQKTLNHKMAKRQKQPIHQLRIRPLPRLSRAGLSKCRLTISTIIRFSHPTRRNMKFQQ

SEQ ID NO: 829594 - protein, 253 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNWYAGGPLER

SEQ ID NO: 829595 - protein, 270 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKEKKKKKKKKKKKKKGGQEKEKPQGAPKISEPKIRGQGGPQRGTKKK

SEQ ID NO: 829596 - protein, 235 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGLFSFCIGYTVKSEFQK

SEQ ID NO: 829597 - protein, 193 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGTGR

SEQ ID NO: 829598 - protein, 162 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPLPGVILLY

SEQ ID NO: 829599 - protein, 179 aa, Homo sapiens
SFRGTAGPTLTLKKAHVPPGFYSGWTEDRCLQDEGSLSHRLEFVWFELPVCTKEGSPMSYLNFAEEALSTYYMRRPYGRRPQYSNPPVQGEVMEGADNQGAGEQGRPVRQNMYRGYRPRFRRGPPRQRQPREDGNEEDKENQGDETQGQQPPQRRYRRNCTERNCTRGVPLDVAAPSTA

SEQ ID NO: 829600 - protein, 284 aa, Homo sapiens; identical to SEQ ID NO: 829585

SEQ ID NO: 829601 - protein, 127 aa, Homo sapiens
MRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 829602 - protein, 284 aa, Homo sapiens; identical to SEQ ID NO: 829585

SEQ ID NO: 829603 - protein, 284 aa, Homo sapiens; identical to SEQ ID NO: 829585

SEQ ID NO: 829604 - protein, 284 aa, Homo sapiens; identical to SEQ ID NO: 829585

SEQ ID NO: 829605 - protein, 284 aa, Homo sapiens; identical to SEQ ID NO: 829585

SEQ ID NO: 829606 - protein, 104 aa, Homo sapiens
MSRALLAKDSLERTAMKKIKKIKEMRPKVSSHLNVGTAATSITDADAQKTLNHKMAKRQKQPIHQLRIRPLPRLSRAGLSKCRLTISTIIRFSHPTRRNMKFQQ

SEQ ID NO: 829607 - protein, 130 aa, Homo sapiens
SRSSYERSYERIVTSARTSVDSARRPRKTTCMQVKVIHCIHVLPLRNTENLTKKTISTYMKVGARYAYERKNQGDETQGQQPPQRRYRRNFNYRRRRPENPKPQDGKETKAADPPAENSSAPEAEQGGAE

SEQ ID NO: 829608 - protein, 284 aa, Homo sapiens; identical to SEQ ID NO: 829585

SEQ ID NO: 829609 - protein, 273 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPADGE

SEQ ID NO: 829610 - protein, 235 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPRESQFDGDSRQHMKKSGRMK

SEQ ID NO: 829611 - protein, 191 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNISRGHHLF

SEQ ID NO: 829612 - protein, 232 aa, Homo sapiens
VSRRLYGVPRGPEGVFTQGFGNSKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMERLWSLMLLKEKRVRRQQMLQVLVVFQFKAVNMQQTVTIIDAIHVVGVLHGVPS

SEQ ID NO: 829613 - protein, 549 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 829614 - protein, 121 aa, Homo sapiens
CAVLGFFAWLPGVKRPGWAINRPWLGRTEKGRSLLWDFSCLVFFSDVAWSGRKVPAASLSLLFCERGKYPLWKIRTTQLCCLPMSLRKYFLKLMGQTADSCLGEVIAVPYVLPPCLQQIFS

SEQ ID NO: 829615 - protein, 561 aa, Homo sapiens
MASASSGPSSSVGFSSFDPAVPSCTLSSASGIKRPMASEVLEARQDSYISLVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 829616 - protein, 545 aa, Homo sapiens
FNFLCCGVSGKRASGIKRPMASEVLEARQDSYISLVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 829617 - protein, 371 aa, Homo sapiens
MSHCTWLFSSSVLSSASSLGNENLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 829618 - protein, 121 aa, Homo sapiens; identical to SEQ ID NO: 829614

SEQ ID NO: 829619 - protein, 469 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPCKWFLPIDCLLLPSGSLTPREQRAGHLW

SEQ ID NO: 829620 - protein, 224 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMSLALLSKPRLGHCSPVWAESETLS

SEQ ID NO: 829621 - protein, 364 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLTHSLTHSLTHHSLTHSLTHSSLTHSLTHSLITHSLTHSLTHHSLTHSLTHSSLTHSLTHSLITHSLTHSLTHHSLTHSLTHSSLTHSLTHSLITHSLTHSLTHHSLTHSLTHSSLTHSLTHSLITHSLTHSLTHHSLTHSLTHSSLTHSLTHSLITHSLTHSLTHHSLTHSLTHSSLTHSLTHSLITHSLTHSLTHHSLTHSLTHSSLTHSLTHSLITHSLTHSLTHHSLTHSLTHSSLTHSLTHSLITHSLTHSLTHHSLTHSLTHS

SEQ ID NO: 829622 - protein, 500 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPCVHLGRPDVLPQTPPLEEISEGSPIPDPSFSPLVGETLQMLTTSTTLEKLEVAESEFTH

SEQ ID NO: 829623 - protein, 514 aa, Homo sapiens
MASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 829624 - protein, 504 aa, Homo sapiens
MPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 829625 - protein, 561 aa, Homo sapiens; identical to SEQ ID NO: 829615

SEQ ID NO: 829626 - protein, 319 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVSLLLRHQKSQLLKQLDCS

SEQ ID NO: 829627 - protein, 113 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPRYRV

SEQ ID NO: 829628 - protein, 123 aa, Homo sapiens
CAVLGFFAWLPGVKRPGWAINRPWLGRTEKGRSLLWDFSCLVFFSDVAWSGRKVPAASLSLLFCERGKYPLWKAVKLVEGVRDVSSSPCQANGVALSWSRSRLDVSEGGPGGGGEVAHRTRVL

SEQ ID NO: 829629 - protein, 1035 aa, Homo sapiens
MGKAENYELYSVELGPGPGGDMAAKMSKKKKAGGGGGKRKEKLENMKKEMEINDHQLSVAELEQKYQTSATKGLSASLAAELLLRDGPNALRPPRGTPEYVKFARQLAGGLQCLMWVAAAICLIAFAIQASEGDLTTDDNLYLAIALIAVVVVTGCFGYYQEFKSTNIIASFKNLVPQQATVIRDGDKFQINADQLVVGDLVEMKGGDRVPADIRILAAQGCKVDNSSLTGESEPQTRSPECTHESPLETRNIAFFSTMCLEGTVQGLVVNTGDRTIIGRIASLASGVENEKTPIAIEIEHFVDIIAGLAILFGATFFIVAMCIGYTFLRAMVFFMAIVVAYVPEGLLATVTVCLSLTAKRLASKNCVVKNLEAVETLGSTSVICSDKTGTLTQNRMTVSHLWFDNHIHTADTTEDQSGQTFDQSSETWRALCRVLTLCNRAAFKSGQDAVPVPKRIVIGDASETALLKFSELTLGNAMGYRDRFPKVCEIPFNSTNKFQLSIHTLEDPRDPRHLLVMKGAPERVLERCSSILIKGQELPLDEQWREAFQTAYLSLGGLGERVLGFCQLYLNEKDYPPGYAFDVEAMNFPSSGLCFAGLVSMIDPPRATVPDAVLKCRTAGIRVIMVTGDHPITAKAIAASVGIISEGSETVEDIAARLRVPVDQVNRKDARACVINGMQLKDMDPSELVEALRTHPEMVFARTSPQQKLVIVESCQRLGAIVAVTGDGVNDSPALKKADIGVAMGIAGSDAAKNAADMILLDDNFASIVTGVEQGRLIFDNLKKSIAYTLTKNIPELTPYLIYITVSVPLPLGCITILFIELCTDIFPSVSLAYEKAESDIMHLRPRNPKRDRLVNEPLAAYSYFQIGAIQSFAGFTDYFTAMAQEGWFPLLCVGLRAQWEDHHLQDLQDSYGQEWTFGQRLYQQYTCYTVFFISIEVCQIADVLIRKTRRLSAFQQGFFRNKILVIAIVFQVCIGCFLCYCPGMPNIFNFMPIRFQWWLVPLPYGILIFVYDEIRKLGVRCCPGSWWDQELYY

SEQ ID NO: 829630 - protein, 781 aa, Homo sapiens
MSPDLPQSARLCEENFQNLGWDSSERGLATVSGQTGEGVPNKALAEQKLGPRKHLVFAEARCTRSPAAGVKPSPFFDAGKRTGSQGGSPACGAHPFPKVCLSLTAKRLASKNCVVKNLEAVETLGSTSVICSDKTGTLTQNRMTVSHLWFDNHIHTADTTEDQSGQTFDQSSETWRALCRVLTLCNRAAFKSGQDAVPVPKRIVIGDASETALLKFSELTLGNAMGYRDRFPKVCEIPFNSTNKFQLSIHTLEDPRDPRHLLVMKGAPERVLERCSSILIKGQELPLDEQWREAFQTAYLSLGGLGERVLGFCQLYLNEKDYPPGYAFDVEAMNFPSSGLCFAGLVSMIDPPRATVPDAVLKCRTAGIRVIMVTGDHPITAKAIAASVGIISEGSETVEDIAARLRVPVDQVNRKDARACVINGMQLKDMDPSELVEALRTHPEMVFARTSPQQKLVIVESCQRLGAIVAVTGDGVNDSPALKKADIGVAMGIAGSDAAKNAADMILLDDNFASIVTGVEQGRLIFDNLKKSIAYTLTKNIPELTPYLIYITVSVPLPLGCITILFIELCTDIFPSVSLAYEKAESDIMHLRPRNPKRDRLVNEPLAAYSYFQIGAIQSFAGFTDYFTAMAQEGWFPLLCVGLRAQWEDHHLQDLQDSYGQEWTFGQRLYQQYTCYTVFFISIEVCQIADVLIRKTRRLSAFQQGFFRNKILVIAIVFQVCIGCFLCYCPGMPNIFNFMPIRFQWWLVPLPYGILIFVYDEIRKLGVRCCPGSWWDQELYY

SEQ ID NO: 829631 - protein, 1941 aa, Homo sapiens
MTLIPEQEPMEIDSEPGVENVFEVSKTQDNRNNNSQQDIDSENMKQKTSATVQKDELRTCTADSKATAPAYKPGRGTGVNSNSEKHADHRSTLTKKMHIQSAVSKMNPGEKEPIHRGTTEVNIDSETVHRMLLSAPSENDRVQKNLKNTAAEEHVAQGDATLEHSTNLDSSPSLSSVTVVPLRESYDPDVIPLFDKRTVLEGSTASTSPADHSALPNQSLTVRESEVLKTSDSKEGGEGFTVDTPAKASITSKRHIPEAHQATLLDGKQGKVIMPLGSKLTGVIVENENITKEGGLVDMAKKENDLNAEPNLKQTIKATVENGKKDGIAVDHVVGLNTEKYAETVKLKHKRSPGKVKDISIDVERRNENSEVDTSAGSGSAPSVLHQRNGQTEDVATGPRRAEKTSVATSTEGKDKDVTLSPVKAGPATTTSSETRQSEVALPCTSIEADEGLIIGTHSRNNPLHVGAEASECTVFAAAEEGGAVVTEGFAESETFLTSTKEGESGECAVAESEDRAADLLAVHAVKIEANVNSVVTEEKDDAVTSAGSEEKCDGSLSRDSEIVEGTITFISEVESDGAVTSAGTEIRAGSISSEEVDGSQGNMMRMGPKKETEGTVTCTGAEGRSDNFVICSVTGAGPREERMVTGAGVVLGDNDAPPGTSASQEGDGSVNDGTEGESAVTSTGITEDGEGPASCTGSEDSSEGFAISSESEENGESAMDSTVAKEGTNVPLVAAGPCDDEGIVTSTGAKEEDEEGEDVVTSTGRGNEIGHASTCTGLGEESEGVLICESAEGDSQIGTVVEHVEAEAGAAIMNANENNVDSMSGTEKGSKDTDICSSAKGIVESSVTSAVSGKDEVTPVPGGCEGPMTSAASDQSDSQLEKVEDTTISTGLVGGSYDVLVSGEVPECEVAHTSPSEKEDEDIITSVENEECDGLMATTASGDITNQNSLAGGKNQGKVLIISTSTTNDYTPQVSAITDVEGGLSDALRTEENMEGTRVTTEEFEAPMPSAVSGDDSQLTASRSEEKDECAMISTSIGEEFELPISSATTIKCAESLQPVAAAVEERATGPVLISTADFEGPMPSAPPEAESPLASTSKEEKDECALISTSIAEECEASVSGVVVESENERAGTVMEEKDGSGIISTSSVEDCEGPVSSAVPQEEGDPSVTPAEEMGDTAMISTSTSEGCEAVMIGAVLQDEDRLTITRVEDLSDAAIISTSTAECMPISASIDRHEENQLTADNPEGNGDLSATEVSKHKVPMPSLIAENNCRCPGPVRGGKEPGPVLAVSTEEGHNGPSVHKPSAGQGHPSAVCAEKEEKHGKECPEIGPFAGRGQKESTLHLINAEEKNVLLNSLQKEDKSPETGTAGGSSTASYSAGRGLEGNANSPAHLRGPEQTSGQTAKDPSVSIRYLAAVNTGAIKADDMPPVQGTVAEHSFLPAEQQGSEDNLKTSTTKCITGQESKIAPSHTMIPPATYSVALLAPKCEQDLTIKNDYSGKWTDQASAEKTGDDNSTRKSFPEEGDIMVTVSSEENVCDIGNEESPLNVLGGLKLKANLKMEAYVPSEEEKNGEILAPPESLCGGKPSGIAELQREPLLVNESLNVENSGFRTNEEIHSESYNKGEISSGRKDNAEAISGHSVEADPKEVEEEERHMPKRKRKQHYLSSEDEPDDNPDVLDSRIETAQRQCPETEPHDTKEENSRDLEELPKTSSETNSTTSRVMEEKDEYSSSETTGEKPEQNDDDTIKSQEEDQPIIIKRKRGRPRKYPVETTLKMKDDSKTDTGIVTVEQSPSSSKLKVMQTDESNKETANLQERSISNDDGEEKIVTSVRRRGRKPKRSLTVSDDAESSEPERKRQKSVSDPVEDKKEQESDEEEEEEEEDEPSGATTRSTTRSEAQRSKTQLSPSIKRKREVSPPGARTRGQQRVEEAPVKKAKR

SEQ ID NO: 829632 - protein, 1721 aa, Homo sapiens
MTLIPEQEPMEIDSEPGVENVFEVSKTQDNRNNNSQQDIDSENMKQKTSATVQKDELRTCTADSKATAPAYKPGRGTGVNSNSEKHADHRSTLTKKMHIQSAVSKMNPGEKEPIHRGTTEVNIDSETVHRMLLSAPSENDRVQKNLKNTAAEEHVAQGDATLEHSTNLDSSPSLSSVTVVPLRESYDPDVIPLFDKRTVLEGSTASTSPADHSALPNQSLTVRESEVLKTSDSKEGGEGFTVDTPAKASITSKRHIPEAHQATLLDGKQGKVIMPLGSKLTGVIVENENITKEGGLVDMAKKENDLNAEPNLKQTIKATVENGKKDGIAVDHVVGLNTEKYAETVKLKHKRSPGKVKDISIDVERRNENSEVDTSAGSGSAPSVLHQRNGQTEDVATGPEETEGRSDNFVICSVTGAGPREERMVTGAGVVLGDNDAPPGTSASQEGDGSVNDGTEGESAVTSTGITEDGEGPASCTGSEDSSEGFAISSESEENGESAMDSTVAKEGTNVPLVAAGPCDDEGIVTSTGAKEEDEEGEDVVTSTGRGNEIGHASTCTGLGEESEGVLICESAEGDSQIGTVVEHVEAEAGAAIMNANENNVDSMSGTEKGSKDTDICSSAKGIVESSVTSAVSGKDEVTPVPGGCEGPMTSAASDQSDSQLEKVEDTTISTGLVGGSYDVLVSGEVPECEVAHTSPSEKEDEDIITSVENEECDGLMATTASGDITNQNSLAGGKNQGKVLIISTSTTNDYTPQVSAITDVEGGLSDALRTEENMEGTRVTTEEFEAPMPSAVSGDDSQLTASRSEEKDECAMISTSIGEEFELPISSATTIKCAESLQPVAAAVEERATGPVLISTADFEGPMPSAPPEAESPLASTSKEEKDECALISTSIAEECEASVSGVVVESENERAGTVMEEKDGSGIISTSSVEDCEGPVSSAVPQEEGDPSVTPAEEMGDTAMISTSTSEGCEAVMIGAVLQDEDRLTITRVEDLSDAAIISTSTAECMPISASIDRHEENQLTADNPEGNGDLSATEVSKHKVPMPSLIAENNCRCPGPVRGGKEPGPVLAVSTEEGHNGPSVHKPSAGQGHPSAVCAEKEEKHGKECPEIGPFAGRGQKESTLHLINAEEKNVLLNSLQKEDKSPETGTAGGSSTASYSAGRGLEGNANSPAHLRGPEQTSGQTAKDPSVSIRYLAAVNTGAIKADDMPPVQGTVAEHSFLPAEQQGSEDNLKTSTTKCITGQESKIAPSHTMIPPATYSVALLAPKCEQDLTIKNDYSGKWTDQASAEKTGDDNSTRKSFPEEGDIMVTVSSEENVCDIGNEESPLNVLGGLKLKANLKMEAYVPSEEEKNGEILAPPESLCGGKPSGIAELQREPLLVNESLNVENSGFRTNEEIHSESYNKGEISSGRKDNAEAISGHSVEADPKEVEEEERHMPKRKRKQHYLSSEDEPDDNPDVLDSRIETAQRQCPETEPHDTKEENSRDLEELPKTSSETNSTTSRVMEEKDEYSSSETTGEKPEQNDDDTIKSQEEDQPIIIKRKRGRPRKYPVETTLKMKDDSKTDTGIVTVEQSPSSSKLKVMQTDESNKETANLQERSISNDDGEEKIVTSVRRRGRKPKRSLTVSDDAESSEPERKRQKSVSDPVEDKKEQESDEEEEEEEEDEPSGATTRSTTRSEAQRSKTQLSPSIKRKREVSPPGARTRGQQRVEEAPVKKAKR

SEQ ID NO: 829633 - protein, 284 aa, Homo sapiens
MPKRKRKQHYLSSEDEPDDNPDVLDSRIETAQRQCPETEPHDTKEENSRDLEELPKTSSETNSTTSRVMEEKDEYSSSETTGEKPEQNDDDTIKSQEEDQPIIIKRKRGRPRKYPVETTLKMKDDSKTDTGIVTVEQSPSSSKLKVMQTDESNKETANLQERSISNDDGEEKIVTSVRRRGRKPKRSLTVSDDAESSEPERKRQKSVSDPVEDKKEQESDEEEEEEEEDEPSGATTRSTTRSEAQRSKTQLSPSIKRKREVSPPGARTRGQQRVEEAPVKKAKR

SEQ ID NO: 829634 - protein, 1988 aa, Homo sapiens
MTLIPEQEPMEIDSEPGVENVFEVSKTQDNRNNNSQQDIDSENMKQKTSATVQKDELRTCTADSKATAPAYKPGRGTGVNSNSEKHADHRSTLTKKMHIQSAVSKMNPGEKEPIHRGTTEVNIDSETVHRMLLSAPSENDRVQKNLKNTAAEEHVAQGDATLEHSTNLDSSPSLSSVTVVPLRESYDPDVIPLFDKRTVLEGSTASTSPADHSALPNQSLTVRESEVLKTSDSKEGGEGFTVDTPAKASITSKRHIPEAHQATLLDGKQGKVIMPLGSKLTGVIVENENITKEGGLVDMAKKENDLNAEPNLKQTIKATVENGKKDGIAVDHVVGLNTEKYAETVKLKHKRSPGKVKDISIDVERRNENSEVDTSAGSGSAPSVLHQRNGQTEDVATGPRRAEKTSVATSTEGKDKDVTLSPVKAGPATTTSSETRQSEVALPCTSIEADEGLIIGTHSRNNPLHVGAEASECTVFAAAEEGGAVVTEGFAESETFLTSTKEGESGECAVAESEDRAADLLAVHAVKIEANVNSVVTEEKDDAVTSAGSEEKCDGSLSRDSEIVEGTITFISEVESDGAVTSAGTEIRAGSISSEEVDGSQGNMMRMGPKKETEGTVTCTGAEGRSDNFVICSVTGAGPREERMVTGAGVVLGDNDAPPGTSASQEGDGSVNDGTEGESAVTSTGITEDGEGPASCTGSEDSSEGFAISSESEENGESAMDSTVAKEGTNVPLVAAGPCDDEGIVTSTGAKEEDEEGEDVVTSTGRGNEIGHASTCTGLGEESEGVLICESAEGDSQIGTVVEHVEAEAGAAIMNANENNVDSMSGTEKGSKDTDICSSAKGIVESSVTSAVSGKDEVTPVPGGCEGPMTSAASDQSDSQLEKVEDTTISTGLVGGSYDVLVSGEVPECEVAHTSPSEKEDEDIITSVENEECDGLMATTASGDITNQNSLAGGKNQGKVLIISTSTTNDYTPQVSAITDVEGGLSDALRTEENMEGTRVTTEEFEAPMPSAVSGDDSQLTASRSEEKDECAMISTSIGEEFELPISSATTIKCAESLQPVAAAVEERATGPVLISTADFEGPMPSAPPEAESPLASTSKEEKDECALISTSIAEECEASVSGVVVESENERAGTVMEEKDGSGIISTSSVEDCEGPVSSAVPQEEGDPSVTPAEEMGDTAMISTSTSEGCEAVMIGAVLQDEDRLTITRVEDLSDAAIISTSTAECMPISASIDRHEENQLTADNPEGNGDLSATEVSKHKVPMPSLIAENNCRCPGPVRGGKEPGPVLAVSTEEGHNGPSVHKPSAGQGHPSAVCAEKEEKHGKECPEIGPFAGRGQKESTLHLINAEEKNVLLNSLQKEDKSPETGTAGGSSTASYSAGRGLEGNANSPAHLRGPEQTSGQTAKDPSVSIRYLAAVNTGAIKADDMPPVQGTVAEHSFLPAEQQGSEDNLKTSTTKCITGQESKIAPSHTMIPPATYSVALLAPKCEQDLTIKNDYSGKWTDQASAEKTGDDNSTRKSFPEEGDIMVTVSSEENVCDIGNEESPLNVLGGLKLKANLKMEAYVPSEEEKNGEILAPPESLCGGKPSGIAELQREPLLVNESLNVENSGFRTNEEIHSESYNKGEISSGRKDNAEAISGHSVEADPKEVEEEERHMPKRKRKQHYLSSEDEPDDNPDVLDSRIETAQRQCPETEPHDTKEENSRDLEELPKTSSETNSTTSRVMEEKDEYSSSETTGEKPEQNDDDTIKSQEEDQPIIIKRKRGRPRKYPVETTLKMKDDSKTDTGIVTVEQSPSSSKLKVMQTDESNKETANLQERSISNDDGEEKIVTSVRRRGRKPKRSLTVSDDAESSEPERKRQKSVSDPVEDKKEQESDEEEEEEEEDEPSGATTRSTTRSEAQRKQHSKPSARATSKLGSPDTVSPRNRQKLAKEKLPTSEKVSNSPPLGRSKTQLSPSIKRKREVSPPGARTRGQQRVEEAPVKKAKR

SEQ ID NO: 829635 - protein, 207 aa, Homo sapiens
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNWFNVTGSDKCVFLNPYNIRNRLLIGYIEGTKETGPAMLLWAETS

SEQ ID NO: 829636 - protein, 132 aa, Homo sapiens
MIRHNGRSDMVLRTFFLHTLFRILLFSFYPLLYHHLAQHSILRLVLHAVGIWFLLLLKQSIFLFTVGQYNCPGQYTFSMPSDSHVSSCSEDWVGYQRKCYFISTVKRSWTSAQNACSEHGATLAVIDSEKDM

SEQ ID NO: 829637 - protein, 199 aa, Homo sapiens
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNWFNVTGSDKCVFLKNTEVSSMECEKNLYWICNKPYK

SEQ ID NO: 829638 - protein, 135 aa, Homo sapiens
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMVRIKKR

SEQ ID NO: 829639 - protein, 862 aa, Homo sapiens
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 829640 - protein, 862 aa, Homo sapiens; identical to SEQ ID NO: 829639

SEQ ID NO: 829641 - protein, 903 aa, Homo sapiens
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSENGVSLCLPRLECNSAISAHCNLCLPGLSDSPISASRVAGFTGASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 829642 - protein, 878 aa, Homo sapiens
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVARVDDNMNTQNLVPFLQREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 829643 - protein, 360 aa, Homo sapiens
MPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 829644 - protein, 257 aa, Homo sapiens [sequence omitted]

SEQ ID NO: 829645 - protein, 862 aa, Homo sapiens; identical to SEQ ID NO: 829639

SEQ ID NO: 829646 - protein, 830 aa, Homo sapiens [sequence omitted]

SEQ ID NO: 829647 - protein, 475 aa, Homo sapiens [sequence omitted]

SEQ ID NO: 829648 - protein, 475 aa, Homo sapiens [sequence omitted]

SEQ ID NO: 829649 - protein, 862 aa, Homo sapiens; identical to SEQ ID NO: 829639

SEQ ID NO: 829650 - protein, 862 aa, Homo sapiens; identical to SEQ ID NO: 829639

SEQ ID NO: 829651 - protein, 820 aa, Homo sapiens
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMVLIAWTCHHTRAMSN

SEQ ID NO: 829652 - protein, 357 aa, Homo sapiens
PCNPSSRRKTLFEDFFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 829653 - protein, 164 aa, Homo sapiens [sequence omitted]

SEQ ID NO: 829654 - protein, 698 aa, Homo sapiens
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIR

SEQ ID NO: 829655 - protein, 565 aa, Homo sapiens
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVARMKKVLSGVTVIR

SEQ ID NO: 829656 - protein, 74 aa, Homo sapiens
ERQDPGFKISEVFLDSVLPPPPLKLLGLLPSGQAHWGSASHLSGSPGLLSFLLPKCVPASALILPYCLVSEPLS

SEQ ID NO: 829657 - protein, 338 aa, Homo sapiens [sequence omitted]

SEQ ID NO: 829658 - protein, 262 aa, Homo sapiens
MSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 829659 - protein, 376 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTEPLEVGKWSVGIKDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 829660 - protein, 475 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYG

SEQ ID NO: 829661 - protein, 266 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQW

SEQ ID NO: 829662 - protein, 282 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQCWQTHQNLKDMSMFWRH

SEQ ID NO: 829663 - protein, 593 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 829664 - protein, 536 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMEVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 829665 - protein, 626 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGEFWGQISLVWISGPAFSSSCVLLPVDSGNLEKEELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 829666 - protein, 491 aa, Homo sapiens
MVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 829667 - protein, 491 aa, Homo sapiens; identical to SEQ ID NO: 829666

SEQ ID NO: 829668 - protein, 357 aa, Homo sapiens
LFFFFLRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 829669 - protein, 508 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGEFWGQISLVWISGPAFSSSCVLLPVDSGNLEKEELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYG

SEQ ID NO: 829670 - protein, 509 aa, Homo sapiens
DKLDIDFCVPGFPWRCGRRSLCDLYEEEEEEDVKMAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 829671 - protein, 132 aa, Homo sapiens
CEASTALMSFTQNNDDRLNVIPRKKPSHSIHNSLIPTIVIVAIYDYTKDKEDELSFQEGAIIYVIKKNDDGWYEGVMNGVTVNNGSFLKGIFLVFCIVINCHNLFQVRTWSPRWVLFSIRITILNHSSFLLF

SEQ ID NO: 829672 - protein, 438 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPERARTNIRHHGYCGHVSDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829673 - protein, 452 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829674 - protein, 484 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829675 - protein, 409 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829676 - protein, 475 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 829677 - protein, 475 aa, Homo sapiens; identical to SEQ ID NO: 829676

SEQ ID NO: 829678 - protein, 486 aa, Homo sapiens
DKLDIDFCVPGFPWRCGRRSLCDLYEEEEEEDVKMAELQMLLEEEIPGGRRALFDSYTNLERVADYCENNYIQSADKQALEETKAYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829679 - protein, 367 aa, Homo sapiens
MAELQMLLEEEIPGGRRALFDSYTNLERVADYCENNYIQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829680 - protein, 549 aa, Homo sapiens
DKLDIDFCVPGFPWRCGRRSLCDLYEEEEEEDVKMAELQMLLEEEIPGGRRALFDSYTNLERVADYCENNYIQSADKQRALEETKAYTTQSLASVAYLINTLANNVLQMLDIQASQLRRMESSINHISQEIRGVDLESTFVTKFGNNCSLRLNETVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829681 - protein, 505 aa, Homo sapiens
DKLDIDFCVPGFPWRCGRRSLCDLYEEEEEEDVKMAELQMLLEEEIPGGRRALFDSYTNLERVADYCENNYIQSADKQRALEETKAYTTQSLASVAYLINTLANNVLQMLDIQASQLRRMESSINHISQEIRGVDLESTFVTKFGNNCSLRLNETVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 829682 - protein, 449 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDY

SEQ ID NO: 829683 - protein, 344 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVQIHKLTALLKNQL

SEQ ID NO: 829684 - protein, 78 aa, Homo sapiens
ERACARPAGRRRGDRPRSPSARAPPPSPPPLSRAGAVSRSFRVTAAVAAAPPLPVLGFLGAAAAAPSATCMRRRRRRM

SEQ ID NO: 829685 - protein, 299 aa, Homo sapiens
MKMGGLPRTTPPTQKPPSPPMSGKGTLGSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 829686 - protein, 423 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829687 - protein, 423 aa, Homo sapiens; identical to SEQ ID NO: 829686

SEQ ID NO: 829688 - protein, 403 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829689 - protein, 475 aa, Homo sapiens; identical to SEQ ID NO: 829676

SEQ ID NO: 829690 - protein, 475 aa, Homo sapiens; identical to SEQ ID NO: 829676

SEQ ID NO: 829691 - protein, 286 aa, Homo sapiens
GTGVIECHPALVPMSVKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDHDMS

SEQ ID NO: 829692 - protein, 513 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 829693 - protein, 374 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDRVKQ

SEQ ID NO: 829694 - protein, 139 aa, Homo sapiens
DKLDIDFSVPGFPWRCGRRSLCDLYEEEEEEDVKMAELQMLLEEEIPGGRRALFDSYTNLERVADYCENNYIQSADKQRALEETKAYTTQSLASVAYLINTLANNVLQMLDIQASQLRRMESSINHISQVRPQYFPICL

SEQ ID NO: 829695 - protein, 117 aa, Homo sapiens
ESARRTRPGRAAAPGGRAERNVVSLCCPVLASSEPPTSAFQSVGIIGVSHCTWHSLKTFWKKLKLSFSTLLILCFCWSAYHLMASKTNAKFLSDYAVLRDYLKLHSKARYTTNFEME

SEQ ID NO: 829696 - protein, 1804 aa, Homo sapiens
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMAYSYRGPQDFNSFVLEQHEYTEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 829697 - protein, 1783 aa, Homo sapiens
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 829698 - protein, 1783 aa, Homo sapiens; identical to SEQ ID NO: 829697

SEQ ID NO: 829699 - protein, 1475 aa, Homo sapiens
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWSVIRAMAMK

SEQ ID NO: 829700 - protein, 387 aa, Homo sapiens
RAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 829701 - protein, 1741 aa, Homo sapiens
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSRLVPVQGQYSAPCVTSATDCICGEKRWKPHGVAE

SEQ ID NO: 829702 - protein, 1589 aa, Homo sapiens
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPSSLIFLLGSFRTRSGKLPTPVMTSNLSSKGSLHIKSLPDNFKRD

SEQ ID NO: 829703 - protein, 764 aa, Homo sapiens
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSDLNYLIPVDRED

SEQ ID NO: 829704 - protein, 44 aa, Homo sapiens
LGMKSLHGKWSFSCSLDGPVDDGQCPQTWLPLMCSERGPVSMLR

SEQ ID NO: 829705 - protein, 106 aa, Homo sapiens [sequence omitted]

SEQ ID NO: 829706 - protein, 79 aa, Homo sapiens
TGMNGLDGFDGLDEMDGMDGWMDRMDGWMNAGKGDGKMPPPERAANIPRSISSDGRPLERRTSPGSDIKVTFLIPVTFL

SEQ ID NO: 829707 - protein, 1804 aa, Homo sapiens; identical to SEQ ID NO: 829696

SEQ ID NO: 829708 - protein, 1765 aa, Homo sapiens
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRNPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 829709 - protein, 544 aa, Homo sapiens [sequence omitted]

SEQ ID NO: 829710 - protein, 370 aa, Homo sapiens
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRKKFTEWVFNTIDMS

SEQ ID NO: 829711 - protein, 117 aa, Homo sapiens; identical to SEQ ID NO: 829695

SEQ ID NO: 829712 - protein, 349 aa, Homo sapiens
MQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 829713 - protein, 429 aa, Homo sapiens
MTGKSVKDVDRYQAVLANLLLEEDNKFCADCQSKGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 829714 - protein, 345 aa, Homo sapiens
ADSRGPRRRGLGLSETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 829715 - protein, 429 aa, Homo sapiens; identical to SEQ ID NO: 829713

SEQ ID NO: 829716 - protein, 429 aa, Homo sapiens; identical to SEQ ID NO: 829713

SEQ ID NO: 829717 - protein, 117 aa, Homo sapiens
MTGKSVKDVDRYQAVLANLLLEEDNKFCADCQSKGPRWASWNIGVFICIRCAGIHRNLGVHISRVKSVNLDQWTQEQIQCMQEMGNGKANRLYEAYLPETFRRPQIDPYLFWSNLEG

SEQ ID NO: 829718 - protein, 429 aa, Homo sapiens; identical to SEQ ID NO: 829713

SEQ ID NO: 829719 - protein, 399 aa, Homo sapiens
MIFKGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 829720 - protein, 245 aa, Homo sapiens
MDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 829721 - protein, 198 aa, Homo sapiens [sequence omitted]

SEQ ID NO: 829722 - protein, 429 aa, Homo sapiens; identical to SEQ ID NO: 829713

SEQ ID NO: 829723 - protein, 204 aa, Homo sapiens
MTGKSVKDVDRYQAVLANLLLEEDNKFCADCQSKGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLGKSWTFQLPCSYKF

SEQ ID NO: 829724 - protein, 40 aa, Homo sapiens
MTQQMAGMNFYGANGMMNYGQSMSGGNGQAANQTLSPQMW

SEQ ID NO: 829725 - protein, 969 aa, Homo sapiens
MSDTVTVKDETATMKDLEAEVKDTTRVENLIKSENYGKILVEKNEHCIENNIDLQEKIQIQLTQSFEKEEKPSKDEAEKEKASDKLPRKMLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGQPFINPDGSPVVYNPPMTQQPVRSQVPGPPQPPLPAPPQQPAANHIFSQQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 829726 - protein, 965 aa, Homo sapiens
MLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGTALSQSSHGAPVVYPTVSTHSSLSFDGGLNGQVASPSTSFFLLPLEAAGIPPGSILINPQTGQPFINPDGSPVVYNPPMTQQPVRSQVPGPPQPPLPAPPQQPAANHIFSQQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 829727 - protein, 965 aa, Homo sapiens; identical to SEQ ID NO: 829726

SEQ ID NO: 829728 - protein, 480 aa, Homo sapiens
MGDKIWLPFPVLLLAALPPVLLPGAAGFTPSLDSDFTFTLPAGQKECFYQPMPLKASLEIEYQSYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 829729 - protein, 326 aa, Homo sapiens
KVGLQRGTRQLCSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 829730 - protein, 328 aa, Homo sapiens
MVLTLMPPCSSPLCSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 829731 - protein, 329 aa, Homo sapiens
LKISHSPGASETSLCSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 829732 - protein, 562 aa, Homo sapiens
MLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGTALSQSSHGAPVVYPTVSTHSSLSFDGGLNGQVASPSTSFFLLPLEAAGIPPGSILINPQTGQPFINPDGSPVVYNPPMTQQPVRSQVPGPPQPPLPAPPQQPAANHIFSQQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQKETKD

SEQ ID NO: 829733 - protein, 132 aa, Homo sapiens
AEAALAGTPNARLISWMCAVSSIEEQCRASVYRYYGKNISLTLYDEANTNTMKATERYDIFDPRQSIPVRESTVVTRTWDSSCQITDGSLQLTSWLTTVKKNLGLFYFIFVGHHNPKSKGRIRLQAPCRIRK

SEQ ID NO: 829734 - protein, 132 aa, Homo sapiens; identical to SEQ ID NO: 829733

SEQ ID NO: 829735 - protein, 965 aa, Homo sapiens; identical to SEQ ID NO: 829726

SEQ ID NO: 829736 - protein, 549 aa, Homo sapiens [sequence omitted]

SEQ ID NO: 829737 - protein, 670 aa, Homo sapiens
MLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGTALSQSSHGAPVVYPTVSTHSSLSFDGGLNGQVASPSTSFFLLPLEAAGIPPGSILINPQTGQPFINPDGSPVVYNPPMTQQPVRSQVPGPPQPPLPAPPQQPAANHIFSQQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRT

SEQ ID NO: 829738 - protein, 330 aa, Homo sapiens
MIPMEIGGTQKNTNKSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 829739 - protein, 965 aa, Homo sapiens; identical to SEQ ID NO: 829726

SEQ ID NO: 829740 - protein, 565 aa, Homo sapiens
MLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGTALSQSSHGAPVVYPTVSTHSSLSFDGGLNGQVASPSTSFFLLPLEAAGIPPGSILINPQTGQPFINPDGSPVVYNPPMTQQPVRSQVPGPPQPPLPAPPQQPAANHIFSQQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVVPRTGDGSSRYLR

SEQ ID NO: 829741 - protein, 132 aa, Homo sapiens; identical to SEQ ID NO: 829733

SEQ ID NO: 829742 - protein, 91 aa, Homo sapiens
MRMSDTVTVKDETATMKDLEAEVKDTTRVENLIKSENYGKILVEKNEHCIENNIDLQVNRNFSLATNTKYSVYIYVYFHTKLTSQNSKRVS

SEQ ID NO: 829743 - protein, 172 aa, Homo sapiens
MLAAGVGGQGERLAGRRRKMAVESRVTQEEIKKEPEKPIDREKTCPLLLRVFTTNNGRHHRMDEFSRGNVPSSELQIYTWMDATLKELTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 829744 - protein, 153 aa, Homo sapiens
MAVESRVTQEEIKKEPEKPIDREKTCPLLLRVFTTNNGRHHRMDEFSRGNVPSSELQIYTWMDATLKELTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 829745 - protein, 153 aa, Homo sapiens; identical to SEQ ID NO: 829744

SEQ ID NO: 829746 - protein, 115 aa, Homo sapiens
TPECKTTAREHCNRAASCLFTLEMDATLKELTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 829747 - protein, 172 aa, Homo sapiens; identical to SEQ ID NO: 829743

SEQ ID NO: 829748 - protein, 172 aa, Homo sapiens; identical to SEQ ID NO: 829743

SEQ ID NO: 829749 - protein, 172 aa, Homo sapiens; identical to SEQ ID NO: 829743

SEQ ID NO: 829750 - protein, 137 aa, Homo sapiens
TEALARIRLPSAVYLVYNTNNGRHHRMDEFSRGNVPSSELQIYTWMDATLKELTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 829751 - protein, 131 aa, Homo sapiens
MAEGVLMLAAGVGGQGERLAGRRRKMAVESRVTQEEIKKEPEKPIDREKTCPLLLRVFTTNNGRHHRMDEFSRGNVPSSELQIYTWMDATLKELTSLVKEVYPEARKKGTHFNFAIVFTDVKRPGYRQKGD

SEQ ID NO: 829752 - protein, 108 aa, Homo sapiens
RVINSKIIPQSPSDILAIMAEECSCSLQGSEVRASVSQAVGGRWRWSRALPRRKLRRSQRNRSTARRHAHCCYGSSPPITAATTEWTSSPGEMYRPASCRSTLGWMQL

SEQ ID NO: 829753 - protein, 152 aa, Homo sapiens
MLAAGVGGQGERLAGRRRKMAVESRVTQEEIKKEPEKPIDREKTCPLLLRVFTTNNGRHHRMDEFSQLTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 829754 - protein, 172 aa, Homo sapiens; identical to SEQ ID NO: 829743

SEQ ID NO: 829755 - protein, 102 aa, Homo sapiens
RVINSKIIPQSPSDIRPFGRGVLMLAAGVGGQGERLAGRRRKMAVESRVTQEEIKKEPEKPIDREKTCPLLLRVFTTNNGRHHRMDEFSRGNVPSSELQIYT

SEQ ID NO: 829756 - protein, 139 aa, Homo sapiens
MAEECSCSLQGSEVRASVSQAVGGRWRWSRALPRRKLRRSQRNRSTARRHAHCCYGSSPPITAATTEWTSSPGEMYRPASCRSTLGEEGGVASGTRAGNLEQQLIAFASVELFSLISISFLHLGPSDSAFRKLEVFVVR

SEQ ID NO: 829757 - protein, 96 aa, Homo sapiens
RVINSKIIPQSPSDIRPFGRGVLMLAAGVGGQGERLAGRRRKMAVESRVTQEEIKKEPEKPIDREKTCPLLLRVFTTNNGRHHRMDEFSPGTWNNS

SEQ ID NO: 829758 - protein, 172 aa, Homo sapiens; identical to SEQ ID NO: 829743

SEQ ID NO: 829759 - protein, 104 aa, Homo sapiens
MYRPASCRSTLEMDATLKELTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 829760 - protein, 172 aa, Homo sapiens; identical to SEQ ID NO: 829743

SEQ ID NO: 829761 - protein, 172 aa, Homo sapiens; identical to SEQ ID NO: 829743

SEQ ID NO: 829762 - protein, 172 aa, Homo sapiens; identical to SEQ ID NO: 829743

SEQ ID NO: 829763 - protein, 172 aa, Homo sapiens; identical to SEQ ID NO: 829743

SEQ ID NO: 829764 - protein, 172 aa, Homo sapiens; identical to SEQ ID NO: 829743

SEQ ID NO: 829765 - protein, 172 aa, Homo sapiens; identical to SEQ ID NO: 829743

SEQ ID NO: 829766 - protein, 137 aa, Homo sapiens
MAEGVLMLAAGVGGQGERLAGRRRKMAVESRVTQEEIKKEPEKPIDREKTCPLLLRVFTTNNGRHHRMDEFSRGNVPSSELQIYTWMDATLKELTSLVKEVYPEARKKGTHFNFAIVFTDVKRPGYRVKEIGSSPLS

SEQ ID NO: 829767 - protein, 443 aa, Homo sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAGSSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWGEGLHQLREALKILAERVLILETMIGLYEPELGSGAGPAGTGTPSLLRGKRGGHATNYRIVAPRSRDERG

SEQ ID NO: 829768 - protein, 462 aa, Homo sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAGSSASLEPMWSGSTMRRMALRPTAFSGCLNCSKVSELTERLKVLEAKMTMLTVIEQPVPPTPATPEDPAPLWGPPPAQGSPGDGGLQGLPGAIESVRVPLLPRNDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWAPSLQSFLQQQAQLELLARRVTLLEAIIWPEPELGSGAGPAGTGTPSLLRGKRGGHATNYRIVAPRSRDERG

SEQ ID NO: 829769 - protein, 417 aa, Homo sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWAPSLQSFLQQQAQLELLARRVTLLEAIIWPEPELGSGAGPAGTGTPSLLRGKRGGHATNYRIVAPRSRDERG

SEQ ID NO: 829770 - protein, 232 aa, Homo sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAGSSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGECPQCC

SEQ ID NO: 829771 - protein, 50 aa, Homo sapiens
ELVLLCGDPHHLMPCAEWHLPSASAAELPLAHELSGEQVNEVEKELMAFQ

SEQ ID NO: 829772 - protein, 445 aa, Homo sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAGSSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWAPSLQSFLQQQAQLELLARRVTLLEAIIWPEPELGSGAGPAGTGTPSLLRGKRGGHATNYRIVAPRSRDERG

SEQ ID NO: 829773 - protein, 468 aa, Homo sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAGSSASLEPMWSGSTMRRMALRPTAFSETEGFLRGSLGPLALAPASSLPAGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWAPSLQSFLQQQAQLELLARRVTLLEAIIWPEPELGSGAGPAGTGTPSLLRGKRGGHATNYRIVAPRSRDERG

SEQ ID NO: 829774 - protein, 368 aa, Homo sapiens
RPPAAELETGLRASGAAGGAGRQAGRTGWGRRPRGAARGGRLVQHGRPAGLGAALPRAPAPGRRRCVEHRGSSVLRTQMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWAPSLQSFLQQQAQLELLARRVTLLEAIIWPEPELGSGAGPAGTGTPSLLRGKRGGHATNYRIVAPRSRDERG

SEQ ID NO: 829775 - protein, 1401 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829776 - protein, 1436 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEHPETGSTTWHRDGGSILGLGRSTRPAPGPFLSYGAERRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829777 - protein, 1364 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829778 - protein, 1349 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQERVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829779 - protein, 505 aa, Homo sapiens
RDERIPSAGPKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829780 - protein, 389 aa, Homo sapiens
MADGSRGQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829781 - protein, 195 aa, Homo sapiens
ADLNLVLYVCETVDPAQFGQPPCPLSQPVLLSLSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829782 - protein, 1214 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSCGVI

SEQ ID NO: 829783 - protein, 993 aa, Homo sapiens
NSWGGKDYKGASLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829784 - protein, 708 aa, Homo sapiens
GPDVSFVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829785 - protein, 1311 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829786 - protein, 1338 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLR

SEQ ID NO: 829787 - protein, 270 aa, Homo sapiens
RFSTHPSKWHVQAVGPLPLDHEGSMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 829788 - protein, 1401 aa, Homo sapiens; identical to SEQ ID NO: 829775

SEQ ID NO: 829789 - protein, 952 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGGSALGSRLTEHQGENPLRTAQH

SEQ ID NO: 829790 - protein, 272 aa, Homo sapiens
MMIHGFQSSHRDFCFGPWKLTASKTHIMKSADVEKLADELHMPSLPEMMFGDNVLRIQHGSGFGIEFNATDALRCVNNYQGMLKVACAEEWQESRTEGEHSKEVIKPYDWTYTTDYKGTLLGESLKLKVVPTTDHIDTEKLKAREQIKFFEEVLLFEDELHDHGVSSLSVKIRVMPSSFFLLLRFFLRIDGVLIRMNDTRLYHEADKTYMLREYTSRESKISSLMHVPPSLFTEPNEISQYLPIKEAVCEKLIFPERIDPNPADSQKSTQVE

SEQ ID NO: 829791 - protein, 272 aa, Homo sapiens; identical to SEQ ID NO: 829790

SEQ ID NO: 829792 - protein, 178 aa, Homo sapiens
MMIHGFQSSHRDFCFGPWKLTASKTHIMKSADVEKLADELHMPSLPEMMFGDNVLRIQHGSGFGIEFNATDALRCVNNYQGMLKVACAEEWQESRTEGEHSKEVIKPYDWTYTTDYKGTLLGESLKLKVVPTTDHIDTEKLKAREQIKFFEEVLLFEDELHDHGVSSLSVKIPGGGHL

SEQ ID NO: 829793 - protein, 118 aa, Homo sapiens
WPVRGLLDPRSSRLSVKIRVMPSSFFLLLRFFLRIDGVLIRMNDTRLYHEADKTYMLREYTSRESKISSLMHVPPSLFTEPNEISQYLPIKEAVCEKLIFPERIDPNPADSQKSTQVE

SEQ ID NO: 829794 - protein, 1211 aa, Homo sapiens
AGVRGRRCRARSPRRPEGNHYQMRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEGDKSPPKLEPSDALPLPSNSETNSEPPTLKPVELNPEQSKLFKRVTFDNESHSACTQSALVSGRPPEPTRASSGDVPAAAASAVAEPASDVNRRTSVLFCKSKSVSPPKSAKNTETQPTSPQLGTKTFLSVVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 829795 - protein, 741 aa, Homo sapiens
YTECLCFRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEGDKSPPKLEPSDALPLPSNSETNSEPPTLKPVELNPEQSKLFKRVTFDNESHSACTQSALVSGRPPEPTRASSGDVPAAAASAVAEPASDVNRRTSVLFCKSKSVSPPKSAKNTETQPTSPQLGTKTFLSVVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 829796 - protein, 1058 aa, Homo sapiens
MRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 829797 - protein, 1189 aa, Homo sapiens
MRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEGDKSPPKLEPSDALPLPSNSETNSEPPTLKPVELNPEQSKLFKRVTFDNESHSACTQSALVSGRPPEPTRASSGDVPAAAASAVAEPASDVNRRTSVLFCKSKSVSPPKSAKNTETQPTSPQLGTKTFLSVVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 829798 - protein, 1130 aa, Homo sapiens
AGVRGRRCRARSPRRPEGNHYQMRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEGDKSPPKLEPSDALPLPSNSETNSEPPTLKPVELNPEQSKLFKRVTFDNESHSACTQSALVSGRPPEPTRASSGDVPAAAASAVAEPASDVNRRTSVLFCKSKSVSPPKSAKNTETQPTSPQLGTKTFLSVVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHKSDPHGLPDAGIPPFHHL

SEQ ID NO: 829799 - protein, 117 aa, Homo sapiens
METKKLIGKPLQPARPVRHLTSPPGAVFPFNFQNEYPCNTQCIQSGVSRCKTNGMQAFSQGLNEQQQQQSPVKKERIKYSRDFLLKLSSVSICRKKPDFLPDHPIVLQKPENNQSFK

SEQ ID NO: 829800 - protein, 117 aa, Homo sapiens; identical to SEQ ID NO: 829799

SEQ ID NO: 829801 - protein, 117 aa, Homo sapiens; identical to SEQ ID NO: 829799

SEQ ID NO: 829802 - protein, 108 aa, Homo sapiens
MEMQEHFHQRSLNEEKTKQKISKIKEKKKKLKITERRIIMLKDIIKVLSHHWKKRKKQSTLYDMDQYPVVNGKKHKKKQTTRLLKIELYKETRIEILKIMGPSWHMKV

SEQ ID NO: 829803 - protein, 110 aa, Homo sapiens
MAPKAKKEAPAPPKAEAKAKALKAKKAVLKGVHSHKKKKIRTSPTFRRPKTLRLRRQPKYPRKSAPRRNKLDHYAIIKFPLTTESAMKKIEDNNTLVFSLWDVKGQQAPD

SEQ ID NO: 829804 - protein, 110 aa, Homo sapiens; identical to SEQ ID NO: 829803

SEQ ID NO: 829805 - protein, 129 aa, Homo sapiens
GQTFGSGKLHASTGWSSMSPGLVVLRWAPAPPKAEAKAKALKAKKAVLKGVHSHKKKKIRTSPTFRRPKTLRLRRQPKYPRKSAPRRNKLDHYAIIKFPLTTESAMKKIEDNNTLVFSLWDVKGQQAPD

SEQ ID NO: 829806 - protein, 123 aa, Homo sapiens
MAFFSPSGRIRVLTLATSMSYSFFTACLIWCLLALKAKKAVLKGVHSHKKKKIRTSPTFRRPKTLRLRRQPKYPRKSAPRRNKLDHYAIIKFPLTTESAMKKIEDNNTLVFSLWDVKGQQAPD

SEQ ID NO: 829807 - protein, 110 aa, Homo sapiens; identical to SEQ ID NO: 829803

SEQ ID NO: 829808 - protein, 129 aa, Homo sapiens; identical to SEQ ID NO: 829805

SEQ ID NO: 829809 - protein, 146 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSE

SEQ ID NO: 829810 - protein, 146 aa, Homo sapiens; identical to SEQ ID NO: 829809

SEQ ID NO: 829811 - protein, 146 aa, Homo sapiens; identical to SEQ ID NO: 829809

SEQ ID NO: 829812 - protein, 146 aa, Homo sapiens; identical to SEQ ID NO: 829809

SEQ ID NO: 829813 - protein, 146 aa, Homo sapiens; identical to SEQ ID NO: 829809

SEQ ID NO: 829814 - protein, 146 aa, Homo sapiens; identical to SEQ ID NO: 829809

SEQ ID NO: 829815 - protein, 146 aa, Homo sapiens; identical to SEQ ID NO: 829809

SEQ ID NO: 829816 - protein, 146 aa, Homo sapiens; identical to SEQ ID NO: 829809

SEQ ID NO: 829817 - protein, 146 aa, Homo sapiens; identical to SEQ ID NO: 829809

SEQ ID NO: 829818 - protein, 146 aa, Homo sapiens; identical to SEQ ID NO: 829809

SEQ ID NO: 829819 - protein, 146 aa, Homo sapiens; identical to SEQ ID NO: 829809

SEQ ID NO: 829820 - protein, 146 aa, Homo sapiens; identical to SEQ ID NO: 829809

SEQ ID NO: 829821 - protein, 146 aa, Homo sapiens; identical to SEQ ID NO: 829809

SEQ ID NO: 829822 - protein, 207 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGESCSHGVPGTTDCREKLLAEAPGHPRALAPCSLEGNSPPAGGRGWGRACGSRLLSLTLLSGPPRVKAVKSSEHINEGETAMLVCKSESVPPVTDWAWYKITDSE

SEQ ID NO: 829823 - protein, 103 aa, Homo sapiens
MRACARVRRRGDRRPRRSPRPRDDAVRARARSAPPPLFIAGRGRRRQRLEVVGPARNRNHGGCAVRAAGIRAAGHPRSLRGCRHSLHYRRRPWLQDTPHLLLE

SEQ ID NO: 829824 - protein, 146 aa, Homo sapiens; identical to SEQ ID NO: 829809

SEQ ID NO: 829825 - protein, 146 aa, Homo sapiens; identical to SEQ ID NO: 829809

SEQ ID NO: 829826 - protein, 146 aa, Homo sapiens; identical to SEQ ID NO: 829809

SEQ ID NO: 829827 - protein, 103 aa, Homo sapiens; identical to SEQ ID NO: 829823

SEQ ID NO: 829828 - protein, 366 aa, Homo sapiens
MAAALFVLLGFALLGTHGASGAAGTVFTTVEDLGSKILLTCSLNDSATEVTGHRWLKGGVVLKEDALPGQKTEFKVWTRDCTKLGAEYFAVFPLAEPNEAAAHTIPVVLRGRSQGVKRHVAHVLVKESTKYRLECACTNRARLARGTLARVQDVSGVPIACYTLNLRALALTNKTLALEHTLEGTYKAALTIRTSGRRVAADAFAFLAYVSLRGVGPRGTTHDLALFGRNPCRPIVEEPRTPRAPCDPGSRHLGDPTHSRKCARSLHTRGPMRIRLLSPAGVARPGATRWGPAPFWDPVRPLGANSRLGRCGEVGVGSLVVQASFPLLCPILERRKRRPGIEPPACGPVLGGIEFDRTARGSLWLP

SEQ ID NO: 829829 - protein, 146 aa, Homo sapiens; identical to SEQ ID NO: 829809

SEQ ID NO: 829830 - protein, 146 aa, Homo sapiens; identical to SEQ ID NO: 829809

SEQ ID NO: 829831 - protein, 146 aa, Homo sapiens; identical to SEQ ID NO: 829809

SEQ ID NO: 829832 - protein, 146 aa, Homo sapiens; identical to SEQ ID NO: 829809

SEQ ID NO: 829833 - protein, 146 aa, Homo sapiens; identical to SEQ ID NO: 829809

SEQ ID NO: 829834 - protein, 146 aa, Homo sapiens; identical to SEQ ID NO: 829809

SEQ ID NO: 829835 - protein, 146 aa, Homo sapiens; identical to SEQ ID NO: 829809

SEQ ID NO: 829836 - protein, 114 aa, Homo sapiens
MRACARVRRRGDRRPRRSPRPRDDAVRARARSAPPPLFIAGRGRRRQRLEVVGPARNRNHGGCAVRAAGIRAAGHPRSLRGWASQSEGCEVVRTHQRGGDGHAGLQVRVRATCH

SEQ ID NO: 829837 - protein, 146 aa, Homo sapiens; identical to SEQ ID NO: 829809

SEQ ID NO: 829838 - protein, 123 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGESCSHGVPGPHERLREQGSS

SEQ ID NO: 829839 - protein, 134 aa, Homo sapiens
MKQSDALPKKAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSE

SEQ ID NO: 829840 - protein, 134 aa, Homo sapiens; identical to SEQ ID NO: 829839

SEQ ID NO: 829841 - protein, 2277 aa, Homo sapiens
MFTYIKIITSGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 829842 - protein, 132 aa, Homo sapiens
GETWCPGEAPGGWSAAAAGAEAGGRGGEGRPERGAGARPAVMCPCPLHRGRGPPAVCACSAGRLGLRSSAAQLTAARLKALGDELHQRTMWRRRARSRRAPAPGALPTYWPWLCAAAQVAALAAWLLGRRNL

SEQ ID NO: 829843 - protein, 132 aa, Homo sapiens; identical to SEQ ID NO: 829842

SEQ ID NO: 829844 - protein, 132 aa, Homo sapiens; identical to SEQ ID NO: 829842

SEQ ID NO: 829845 - protein, 132 aa, Homo sapiens; identical to SEQ ID NO: 829842

SEQ ID NO: 829846 - protein, 198 aa, Homo sapiens
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDEREATDTPIVIQPASATETTQLTADSHPSYHTDGFN

SEQ ID NO: 829847 - protein, 167 aa, Homo sapiens
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDERGGH

SEQ ID NO: 829848 - protein, 167 aa, Homo sapiens; identical to SEQ ID NO: 829847

SEQ ID NO: 829849 - protein, 167 aa, Homo sapiens; identical to SEQ ID NO: 829847

SEQ ID NO: 829850 - protein, 167 aa, Homo sapiens; identical to SEQ ID NO: 829847

SEQ ID NO: 829851 - protein, 198 aa, Homo sapiens; identical to SEQ ID NO: 829846

SEQ ID NO: 829852 - protein, 167 aa, Homo sapiens; identical to SEQ ID NO: 829847

SEQ ID NO: 829853 - protein, 167 aa, Homo sapiens; identical to SEQ ID NO: 829847

SEQ ID NO: 829854 - protein, 167 aa, Homo sapiens; identical to SEQ ID NO: 829847

SEQ ID NO: 829855 - protein, 167 aa, Homo sapiens; identical to SEQ ID NO: 829847

SEQ ID NO: 829856 - protein, 213 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 829857 - protein, 213 aa, Homo sapiens; identical to SEQ ID NO: 829856

SEQ ID NO: 829858 - protein, 308 aa, Homo sapiens
MSGESARSLGKGEACPPRRGGDLGDPRRHVRGCSGSPAARERPTGGERVGAAVGRGGGGIRGVSTPLWAVIAFASPRQEARPRGRSRRARIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 829859 - protein, 213 aa, Homo sapiens; identical to SEQ ID NO: 829856

SEQ ID NO: 829860 - protein, 213 aa, Homo sapiens; identical to SEQ ID NO: 829856

SEQ ID NO: 829861 - protein, 212 aa, Homo sapiens
PPGLKQSSHLSIRSSRDYRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 829862 - protein, 195 aa, Homo sapiens
MRFCPFAERTRLVLKAKGIRHEVININLKNKPEWFFKKNPFGLVPVLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 829863 - protein, 175 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNESKIFEYFVHNLG

SEQ ID NO: 829864 - protein, 175 aa, Homo sapiens; identical to SEQ ID NO: 829863

SEQ ID NO: 829865 - protein, 137 aa, Homo sapiens
PHQGRSRKQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 829866 - protein, 180 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 829867 - protein, 226 aa, Homo sapiens
MSGESARSLGKGEACPPRRGGDLGDPRRHVRGCSGSPAARERPTGGERVGAAVGRGGGGIRGVSTPLWAVIAFASPRQEARPRGRSRRARIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEETNRF

SEQ ID NO: 829868 - protein, 119 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYASADRVGT

SEQ ID NO: 829869 - protein, 86 aa, Homo sapiens
MRFCPFAERTRLVLKAKGIRHEVININLKNKPEWFFKKNPFGLVPVLENSQGQLIYESAITCEYLDEAYPGKKLLPDQRIEWEPLD

SEQ ID NO: 829870 - protein, 213 aa, Homo sapiens; identical to SEQ ID NO: 829856

SEQ ID NO: 829871 - protein, 267 aa, Homo sapiens
MRSGWAHGESPTLSQYPLIWNIVSTAPATAAGLGFQREARPRGRSRRARIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 829872 - protein, 213 aa, Homo sapiens; identical to SEQ ID NO: 829856

SEQ ID NO: 829873 - protein, 278 aa, Homo sapiens
MSGESARSLGKGEACPPRRGGDLGDPRRHVRGCSGSPAARERPTGGEREARPRGRSRRARIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 829874 - protein, 213 aa, Homo sapiens; identical to SEQ ID NO: 829856

SEQ ID NO: 829875 - protein, 213 aa, Homo sapiens; identical to SEQ ID NO: 829856

SEQ ID NO: 829876 - protein, 213 aa, Homo sapiens; identical to SEQ ID NO: 829856

SEQ ID NO: 829877 - protein, 278 aa, Homo sapiens; identical to SEQ ID NO: 829873

SEQ ID NO: 829878 - protein, 113 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAF

SEQ ID NO: 829879 - protein, 131 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEETNRF

SEQ ID NO: 829880 - protein, 143 aa, Homo sapiens
LGEKHSRQSNSKYKYSQEIHRACSGGRSRKQGSWEGQKQDSSGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 829881 - protein, 180 aa, Homo sapiens; identical to SEQ ID NO: 829866

SEQ ID NO: 829882 - protein, 235 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 829883 - protein, 239 aa, Homo sapiens
MRNQAPGRPKGATFPPRRPTGSRAPPLAPELRAKQRPGERVMALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAGNRRRVCKCPRPVVKSGDKPSLSARYV

SEQ ID NO: 829884 - protein, 269 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRTGRRVCKLSPACGQIGQTSPGLQATIRSYPCCQQSNYNYLQTCTIPLPLARNPTSFPYSI

SEQ ID NO: 829885 - protein, 108 aa, Homo sapiens
MDSLSPGVQDQPGQHGEPPSLQKFSQGTEDVFANVPGLWSNRETSPAFRRDTSNPVQQPLHYFKLRSFLLREQVLPFHFFQSSSLCIHSHDYYFSGGGVGKITFSLCV

SEQ ID NO: 829886 - protein, 262 aa, Homo sapiens
MRNQAPGRPKGATFPPRRPTGSRAPPLAPELRAKQRPGERVMALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHSKSRGIAAGRSRP

SEQ ID NO: 829887 - protein, 526 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 829888 - protein, 526 aa, Homo sapiens; identical to SEQ ID NO: 829887

SEQ ID NO: 829889 - protein, 434 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVQSFC

SEQ ID NO: 829890 - protein, 428 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKQKEEPKEVKLSVPMPYTLKVLASQLCSHCKHSSSCTFGALFCVIPQ

SEQ ID NO: 829891 - protein, 170 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKLYIWCTFLCHTTIKKNLSSYKNKTPKSRPKE

SEQ ID NO: 829892 - protein, 526 aa, Homo sapiens; identical to SEQ ID NO: 829887

SEQ ID NO: 829893 - protein, 528 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPLKFNLLDNDVSTQDDFLGHSG

SEQ ID NO: 829894 - protein, 105 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTENKVFVEDCATTDLESTRREV

SEQ ID NO: 829895 - protein, 620 aa, Homo sapiens [sequence omitted]

SEQ ID NO: 829896 - protein, 620 aa, Homo sapiens [sequence omitted]

SEQ ID NO: 829897 - protein, 573 aa, Homo sapiens
MAPSPSLVQVYTSPAAVAVWEWQDGLGTWHPYSATVCSFIEQQFVQQKGQRFGLGSLAHSIPLGQADPSLAPYIIDLPSWTQFRQDTGTMRAVRRHLFPQHSAPGRGVVWEWLSDDGSWTAYEASVCDYLEQQVARGNQLVDLAPLGYNYTVNYTTHTQTNKTSSFCRSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWGAAPPSLGSQPLYRSSLSHLGPQHLPPGSSTSGAVSASLPSGPSSSPGSVPATVPMQMPKPSRVQQALAEATPKPEPEPEQVIKNYTEELKVPPDEDCIICMEKLSAASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 829898 - protein, 620 aa, Homo sapiens [sequence omitted]

SEQ ID NO: 829899 - protein, 832 aa, Homo sapiens
APGMRSGSLGSCDAEFHSGCLLLRVGATARALPRPSRSCSPSAVVPSAPSSCPPQPRCLGICVAESASLSDLPGFCCLWFVSRWELKQVIPPKELVSSSRRDSLCQLSREKRTRLADPAPRIVPSPGPPSRPPSACNFPSGSGTVLEWPVADTEPPASCICCPGSHCQLCQSHWGPQRSQDLPEALGNDPGTPGQRGLKLFGKAAGLLGKMAMAPSPSLVQVYTSPAAVAVWEWQDGLGTWHPYSATVCSFIEQQFVQQKGQRFGLGSLAHSIPLGQADPSLAPYIIDLPSWTQFRQDTGTMRAVRRHLFPQHSAPGRGVVWEWLSDDGSWTAYEASVCDYLEQQVARGNQLVDLAPLGYNYTVNYTTHTQTNKTSSFCRSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWGAAPPSLGSQPLYRSSLSHLGPQHLPPGSSTSGAVSASLPSGPSSSPGSVPATVPMQMPKPSRVQQALAGMTSVLMSAIGLPVCLSRAPQPTSPPASRLASKSHGSVKRLRKMSVKEATPKPEPEPEQVIKNYTEELKVPPDEDCIICMEKLSAASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 829900 - protein, 276 aa, Homo sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPSEAATLPVGCKPGLDPLPSLSP

SEQ ID NO: 829901 - protein, 265 aa, Homo sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWAGPPPQPQPLAWPLCMGLGEMGRRE

SEQ ID NO: 829902 - protein, 320 aa, Homo sapiens
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWAGPPPQPQPLAWPLCMGLGEMGRRE

SEQ ID NO: 829903 - protein, 172 aa, Homo sapiens
MTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPSEAATLPVGCKPGLDPLPSLSP

SEQ ID NO: 829904 - protein, 218 aa, Homo sapiens [sequence omitted]

SEQ ID NO: 829905 - protein, 335 aa, Homo sapiens
MRLPGDCAAVSALLHPPWLLGLSRVPGRWDWGRLCPTELGALCLALSSPVPHTGLPVWAPLAFPPGSLDLFLPFLALWPPLQPVLLRTLLMYFSLLEATPKPEPEPEQVIKNYTEELKVPPDEDCIICMEKLSAASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 829906 - protein, 785 aa, Homo sapiens
APGMRSGSLGSCDAEFHSGCLLLRVGATARALPRPSRSCSPSAVVPSAPSSCPPQPRCLGICVAESASLSDLPGFCCLWFVSRWELKQVIPPKELVSSSRRDSLCQLSREKRNFQLKTLSCTIPPARPPEGTPDLPEALGNDPGTPGQRGLKLFGKAAGLLGKMAMAPSPSLVQVYTSPAAVAVWEWQDGLGTWHPYSATVCSFIEQQFVQQKGQRFGLGSLAHSIPLGQADPSLAPYIIDLPSWTQFRQDTGTMRAVRRHLFPQHSAPGRGVVWEWLSDDGSWTAYEASVCDYLEQQVARGNQLVDLAPLGYNYTVNYTTHTQTNKTSSFCRSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWGAAPPSLGSQPLYRSSLSHLGPQHLPPGSSTSGAVSASLPSGPSSSPGSVPATVPMQMPKPSRVQQALAGMTSVLMSAIGLPVCLSRAPQPTSPPASRLASKSHGSVKRLRKMSVKEATPKPEPEPEQVIKNYTEELKVPPDEDCIICMEKLSAASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 829907 - protein, 620 aa, Homo sapiens [sequence omitted]

SEQ ID NO: 829908 - protein, 289 aa, Homo sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPSEAATLPVGCKPGLDPSTSLLPLLGGTWPGCGLPL

SEQ ID NO: 829909 - protein, 331 aa, Homo sapiens
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPSEAATLPVGCKPGLDPLPSLSP

SEQ ID NO: 829910 - protein, 85 aa, Homo sapiens
WLGKTGNHNGRAADGVGEAGAGGRGEKRQETEKCKRGKSEKCPLPRSMPTALLASPPSFPATLHAHQALPVLQAQPLSLVTKSAH

SEQ ID NO: 829911 - protein, 588 aa, Homo sapiens
MPQLGGGGGGGGGGSGGGGGSSAGAAGGGDDLGANDELIPFQDEGGEEQEPSSDSASAQRDLDEVKSSLVNESENQSSSSDSEAERRPQPVRDTFQKPRDYFAEVRRPQDSAFFKGPPYPGYPFLMIPDLSSPYLSNGPLSPGGARTYLQMKWPLLDVPSSATVKDTRSPSPAHLSNKVPVVQHPHHMHPLTPLITYSNDHFSPGSPPTHLSPEIDPKTGIPRPPHPSELSPYYPLSPGAVGQIPHPLGWLVPQQGQPMYSLPPGGFRHPYPALAMNASMSSLVSSRFSPHMVAPAHPGLPTSGIPHPAIVSPIVKQEPAPPSLSPAVSVKSPVTVKKEEEKKPHVKKPLNAFMLYMKEMRAKVVAECTLKESAAINQILGRKWHNLSREEQAKYYELARKERQLHSQLYPTWSARDNYGKKKKRKREKQLSQTQSQQQVQEAEGALASKSKKPCVQYLPPEKPCDSPASSHGSMLDSPATPSAALASPAAPAATHSEQAQPLSLTTKPETRAQLALHSAAFLSAKAAASSSGQMGSQPPLLSRPLPLGSMPTALLASPPSFPATLHAHQALPVLQAQPLSLVTKSAH

SEQ ID NO: 829912 - protein, 588 aa, Homo sapiens; identical to SEQ ID NO: 829911

SEQ ID NO: 829913 - protein, 441 aa, Homo sapiens
MPQLGGGGGGGGGGSGGGGGSSAGAAGGGDDLGANDELIPFQDEGGEEQEPSSDSASAQRDLDEVKSSLVNESENQSSSSDSEAERRPQPVRDTFQKPRDYFAEVRRPQDSAFFKGPPYPGYPFLMIPDLSSPYLSNGPLSPGGARTYLQMKWPLLDVPSSATVKDTRSPSPAHLSNKVPVVQHPHHMHPLTPLITYSNDHFSPGSPPTHLSPEIDPKTGIPRPPHPSELSPYYPLSPGAVGQIPHPLGWLVPQQGQPMYSLPPGGFRHPYPALAMNASMSSLVSSRFSPHMVAPAHPGLPTSGIPHPAIVSPIVKQEPAPPSLSPAVSVKSPVTVKKEEEKKPHVKKPLNAFMLYMKEMRAKVVAECTLKESAAINQILGRKWHNLSREEQAKYYELARKERQLHSQLYPTWSARDNYVSAHSGQRTLRPQEQPLQEEEG

SEQ ID NO: 829914 - protein, 215 aa, Homo sapiens
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 829915 - protein, 197 aa, Homo sapiens
MYGKSSTRAVLLLLGIQLTALWPIAAVEIYTSRVLEAVNGTDARWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 829916 - protein, 215 aa, Homo sapiens; identical to SEQ ID NO: 829914

SEQ ID NO: 829917 - protein, 195 aa, Homo sapiens
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKS

SEQ ID NO: 829918 - protein, 169 aa, Homo sapiens
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTDDHNSNCSGPLPALPEKAMGRKSS

SEQ ID NO: 829919 - protein, 215 aa, Homo sapiens; identical to SEQ ID NO: 829914

SEQ ID NO: 829920 - protein, 122 aa, Homo sapiens
TYESRTSVPPPTSPTAQTSPTAPRQPDSSPTSPTAPRLARQLPDQPDSSPTSPTAPRLARRCVRITDTGLSYLSTMSSLRSLYLRWCCQVQDFGLKHLLALGSLRLLSLAGCPLLTTTGLSG

SEQ ID NO: 829921 - protein, 122 aa, Homo sapiens
MSSLRSLYLRWCCQVQDFGLKHLLALGSLRLLSLAGCPLLTTTGLSGLVQLQELEELELTNCPGATPELFKYFSQHLPRCLVIELREAPAPVAGTRPDLGGGAGRRRAPSSRLALGGAPAPP

SEQ ID NO: 829922 - protein, 347 aa, Homo sapiens
NGLFWYFSACEKCVLAQVCKAWRRVLYQPKFWAGLTPVLHAKELYNVLPGGEKEFVNLQGFAARGFEGFCLVGVSDLDICEFIDNYALSKKGVKAMSLKRSTITDAGLEVMLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRVCTHHGHWPQLSVHHVVPPQPLPAMVLPGARLRAEAPPGPGEFAPPVSGRLPAAHHHRAVGLVEGILK

SEQ ID NO: 829923 - protein, 457 aa, Homo sapiens
NGLFWYFSACEKCVLAQVCKAWRRVLYQPKFWAGLTPVLHAKELYNVLPGGEKEFVNLQGFAARGFEGFCLVGVSDLDICEFIDNYALSKKGVKAMSLKRSTITDAGLEVMLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRCAPPGRAGRGWAGRGCTGRGGAGLHGAGGGGFRRGWGCGAAGSSPRSLGSGNRRTAARVGWTPVLPGCVRITDTGLSYLSTMSSLRSLYLRWCCQVQDFGLKHLLALGSLRLLSLAGCPLLTTTGLSGLVQLQELEELELTNCPGATPELFKYFSQHLPRCLVIELREAPAPVAGTRP

SEQ ID NO: 829924 - protein, 134 aa, Homo sapiens
PLATDEKILNGLFWYFSACEKCVLAQVCKAWRRVLYQPKFWAGLTPVLHAKELYNVLPGGEKEFVNLQGFAARGFEGFCLVGVSDLDICEFIDNYALSKKGVKAMSLKRSTITDAGLEVCTRLGGDRAGGQGRA

SEQ ID NO: 829925 - protein, 390 aa, Homo sapiens
NGLFWYFSACEKCVLAQVCKAWRRVLYQPKFWAGLTPVLHAKELYNVLPGGEKEFVNLQGFAARGFEGFCLVGVSDLDICEFIDNYALSKKGVKAMSLKRSTITDAGLEVMLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRCVRITDTGLSYLSTMSSLRSLYLRWCCQVQDFGLKHLLALGSLRLLSLAGCPLLTTTGLSGLVQLQELEELELTNCPGATPELFKYFSQHLPRCLVIELREAPAPVAGTRP

SEQ ID NO: 829926 - protein, 76 aa, Homo sapiens
LTNLEPRYPPRLARRCVRITDTGLSYLSTMSSLRSLYLRWCCQVQDFGLKHLLALGSLRLLSLAGCPLLTTTGLSG

SEQ ID NO: 829927 - protein, 503 aa, Homo sapiens
NGLFWYFSACEKCVLAQVCKAWRRVLYQPKFWAGLTPVLHAKELYNVLPGGEKEFVNLQGFAARGFEGFCLVGVSDLDICEFIDNYALSKKGVKAMSLKRSTITDAGLEVMLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRCAPPGRAGRGWAGRGCTGRGGAGLHGAGGGGFRRGWGCGAAGRALGAWGVGTAEPQHGLAGPPSFPVGGSEEGPAAAPGGAGRDSRQGHSQEDEGWPGPGDLKVGVPSGGNHRCVRITDTGLSYLSTMSSLRSLYLRWCCQVQDFGLKHLLALGSLRLLSLAGCPLLTTTGLSGLVQLQELEELELTNCPGATPELFKYFSQHLPRCLVIELREAPAPVAGTRP

SEQ ID NO: 829928 - protein, 379 aa, Homo sapiens
NGLFWYFSACEKCVLAQVCKAWRRVLYQPKFWAGLTPVLHAKELYNVLPGGEKEFVNLQGFAARGFEGFCLVGVSDLDICEFIDNYALSKKGVKAMSLKRSTITDAGLEVMLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRCAPPGRAGRGWAGRGCTGRGGAGLHGAGGGGFRRGWGCGAAGRALGAWGVGTAEPQHGLAGPPSFPGVYASRTLASAICPPCRPSAASTCDGAARCKTSG

SEQ ID NO: 829929 - protein, 77 aa, Homo sapiens
TLEDTLLADHYWLTHYWLTHYWTLNPWYLSTDAALENLILRLQQDVLSTAAVQAALPATSCVPHAKVPRAMSTPEVP

SEQ ID NO: 829930 - protein, 91 aa, Homo sapiens
YRGGYGGGLCTGLGGGFGGGFAGGDGLLVGSEKVTMQNLNDRLASYLDKGHLSFTPRDLPGIQSDTFPTLPVKVSTEEQVTASEFIRTKKG

SEQ ID NO: 829931 - protein, 77 aa, Homo sapiens; identical to SEQ ID NO: 829929

SEQ ID NO: 829932 - protein, 146 aa, Homo sapiens
PGRGAGEERSWFAQVRRLGPHGAVARLRVRGLPGAGRGLRLPAGARAARLGAALSLELAVSGARACAPGTRLPRGPVGGSLGRAYRAASPALAPRGSGVSANGAWVSEPPRSALEVGRSRAETGLLRGPREALLSALAPWREVSDV

SEQ ID NO: 829933 - protein, 588 aa, Homo sapiens
PGRGAGEERSWFAQVRRLGPHGAVARLRVRGLPGAGRGLRLPAGARAARLGAALSLELAVSGARACAPGTRLPRGPVGGSLGRAYRAASPALAPRGSGVSANGAWVSEPPRSALEVGRSRAETGLLRGPREALLSALALGEKCRTSEWNPVRHRCSFHSAGLCAFLSSRVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 829934 - protein, 375 aa, Homo sapiens
MGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 829935 - protein, 375 aa, Homo sapiens; identical to SEQ ID NO: 829934

SEQ ID NO: 829936 - protein, 258 aa, Homo sapiens
MNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 829937 - protein, 506 aa, Homo sapiens
PEEERARKGVGSRRCGAWVPMALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEIVLNPNKPVVEWHREGISFHFTPVLVCKDPIRTVGLGDAISAEGLFYSEVHPHY

SEQ ID NO: 829938 - protein, 418 aa, Homo sapiens
PEEERARKGVGSRRCGAWVPMALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAEVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 829939 - protein, 378 aa, Homo sapiens
PEEERARKGVGSRRCGAWVPMALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 829940 - protein, 322 aa, Homo sapiens
PGRGAGEERSWFAQVRRLGPHGAVARLRVRGLPGAGRGLRLPAGARAARLGAALSLELAVSGARACAPGTRLPRGPVGGSLGRAYRAASPALAPRGSGVLLCGPVGPKLHELLDDNVFVPPESLQEVDEFHLILEYQAEVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 829941 - protein, 517 aa, Homo sapiens
PEEERARKGVGSRRCGAWVPMALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 829942 - protein, 223 aa, Homo sapiens
MAASCRVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 829943 - protein, 517 aa, Homo sapiens; identical to SEQ ID NO: 829941

SEQ ID NO: 829944 - protein, 375 aa, Homo sapiens; identical to SEQ ID NO: 829934

SEQ ID NO: 829945 - protein, 375 aa, Homo sapiens; identical to SEQ ID NO: 829934

SEQ ID NO: 829946 - protein, 513 aa, Homo sapiens
PGRGAGEERSWFAQVRRLGPHGAVARLRVRGLPGAGRGLRLPAGARAARLGAALSLELAVSGARACAPGTRLPRGPVGGSLGRAYRAASPALAPRGSGVSANGAWVSEPPRSALEVGRSRAETGLLRGPREALLSALAPWREVSDVCVEPGSSPLLFPLGWPLRLSLIPHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 829947 - protein, 517 aa, Homo sapiens; identical to SEQ ID NO: 829941

SEQ ID NO: 829948 - protein, 324 aa, Homo sapiens
EGAQSRVRPAEPRAPRPAPAPPPGRPRGGGMSRRPPAPELRAGLEPRAAPRGAKPSPPPPPNRGRTSGRRMQRPGEPAAARFGPPEGCADHRPHRYRSFMIEEILTEPPGPKGAAPAAAAAAAGELLKFGVQALLAARPFHSHLAVLKAEQAAVFKFPLAPLGCSGLSSALLAAGPGLPGAAGAPHLPLELQLRGKLEAAGPGEPGTKAKKGRRSRTVFTELQLMGLEKRFEKQKYLSTPDRIDLAESLGLSQLQVKTWYQNRRMKWKKIVLQGGGLESPTKPKGRPKKNSIPTSEQLTEQERAKDAEKPAEVPGEPSDRSRED

SEQ ID NO: 829949 - protein, 263 aa, Homo sapiens
LRPGELQDRTRTGSRRYSLPNLGNGNVEEGLHLRHRRRPAGRGGFALGGTGQARAPPRHVVRQSLEAEERGRSSPGSSFSFFAAVLKAEQAAVFKFPLAPLGCSGLSSALLAAGPGLPGAAGAPHLPLELQLRGKLEAAGPGEPGTKAKKGRRSRTVFTELQLMGLEKRFEKQKYLSTPDRIDLAESLGLSQLQVKTWYQNRRMKWKKIVLQGGGLESPTKPKGRPKKNSIPTSEQLTEQERAKDAEKPAEVPGEPSDRSRED

SEQ ID NO: 829950 - protein, 598 aa, Homo sapiens [sequence omitted]

SEQ ID NO: 829951 - protein, 309 aa, Homo sapiens
MDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 829952 - protein, 348 aa, Homo sapiens
MGQDGEQARIHPLVPQVPGPVTAAMATGLAVNGKVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVRGALG

SEQ ID NO: 829953 - protein, 570 aa, Homo sapiens
MGQDGEQARIHPLVPQVPGPVTAAMATGLAVNGKVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 829954 - protein, 544 aa, Homo sapiens
MASEELYEVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 829955 - protein, 309 aa, Homo sapiens; identical to SEQ ID NO: 829951

SEQ ID NO: 829956 - protein, 110 aa, Homo sapiens
MFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 829957 - protein, 292 aa, Homo sapiens
MVREGQDGEQARIHPLVPQVPGPVTAAMATGLAVNGKVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKVKGLLTKGKIKKGRQSIWFGGKAMTARTTLGAL

SEQ ID NO: 829958 - protein, 333 aa, Homo sapiens
CACALPSHAANMAPVEHVVADAGAFLRHAALQDIGKNIYTIREVVTEIRDKATRRRLAVLPYELRFKEPLPEYVRLVTEFSKKTGDYPSLSATDIQVLALTYQLEAEFVGVSHLKQEPQKVKVSSSIQHPETPLHISGFHLPYKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGWRAAGTVRFGGPVLWVLVFRTRDEPVGPWADRSLRGGPFVSGRGPARVSGGPQELVGELRCHPPLRTCAAFAS

SEQ ID NO: 829959 - protein, 145 aa, Homo sapiens
MALCDCGSPSSNGPSLSYFQYSLPTPKGGKYAINPHLTEDQRFPQLRLSQKARQKTNVFAPDYIAGVSPFVENDISSRSATLQVRDSTLGAGRRRLNPNASRKKFVKCNCIKTERTTPWSQSSRKEFPKDNIFLINAAATSCAFN

SEQ ID NO: 829960 - protein, 423 aa, Homo sapiens
CACALPSHAANMAPVEHVVADAGAFLRHAALQDIGKNIYTIREVVTEIRDKATRRRLAVLPYELRFKEPLPEYVRLVTEFSKKTGDYPSLSATDIQVLALTYQLEAEFVGVSHLKQEPQKVKVSSSIQHPETPLHISGFHLPYKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTVSDDGTLHMHFSRNPKVLNPRGLRYSLPTPKGGKYAINPHLTEDQRFPQLRLSQKARQKTNVFAPDYIAGVSPFVENDISSRSATLQVRDSTLGAGRRRLNPNASRKKFVKKR

SEQ ID NO: 829961 - protein, 459 aa, Homo sapiens
CACALPSHAANMAPVEHVVADAGAFLRHAALQDIGKNIYTIREVVTEIRDKATRRRLAVLPYELRFKEPLPEYVRLVTEFSKKTGDYPSLSATDIQVLALTYQLEAEFVGVSHLKQEPQKVKVSSSIQHPETPLHISGFHLPYKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTVSDDGTLHMHFSRNPKVLNPRGLRYSLPTPKGGKYAINPHLTEDQRFPQLRLSQKARQKTNVFAPDYIAGVSPFVENDISSRSATLQVRDSTLGAGRRRLNPNASRKKFVKCNCIKTERTTPWSQSSRKEFPKDNIFLINAAATSCAFN

SEQ ID NO: 829962 - protein, 320 aa, Homo sapiens
REREMRERERERERERERERERERQHPETPLHISGFHLPYKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTVSDDGTLHMHFSRNPKVLNPRGLRYSLPTPKGGKYAINPHLTEDQRFPQLRLSQKARQKTNVFAPDYIAGVSPFVENDISSRSATLQVRDSTLGAGRRRLNPNASRKKFVKKR

SEQ ID NO: 829963 - protein, 454 aa, Homo sapiens
CACALPSHAANMAPVEHVVADAGAFLRHAALQDIGKNIYTIREVVTEIRDKATRRRLAVLPYELRFKEPLPEYVRLVTEFSKKTGDYPSLSATDIQVLALTYQLEAEFVGVSHLKQEPQKVKVSSSIQHPETPLHISGFHLPYKPKPPQETEKGHSACEPENLEFSSFMFWRNPLPNIDHELQELLLKRGKGLEGKRGSVREKGGKKGWKGGGNRGGGKQREKKKKKRGFGQKGEKPQEKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTVSDDGTLHMHFSRNPKVLNPRGLRYSLPTPKGGKYAINPHLTEDQRFPQLRLSQKARQKTNVFAPDYIAGVSPFVENDISSRSATLQVRDSTLGAGRRRLNPNASRKKFVKKR

SEQ ID NO: 829964 - protein, 109 aa, Homo sapiens [sequence omitted]

SEQ ID NO: 829965 - protein, 423 aa, Homo sapiens; identical to SEQ ID NO: 829960

SEQ ID NO: 829966 - protein, 466 aa, Homo sapiens
CACALPSHAANMAPVEHVVADAGAFLRHAALQDIGKNIYTIREVVTEIRDKATRRRLAVLPYELRFKEPLPEYVRLVTEFSKKTGDYPSLSATDIQVLALTYQLEAEFVGVSHLKQEPQKVKVSSSIQHPETPLHISGFHLPYKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTVSDDGTLHMHFSRNPKVLNPRGLRYSLPTPKGGKYAINPHLTEDQRFPQLRLSQKARQKTNVFAPDYIAGVSPFVENDISSRSATLQVRDSTLGAGRRRLNPNASRKKFVKGERVRSNGGVARSPGPSRGVRPGKKGRGAHPVKGRDTCGGKNRQR

SEQ ID NO: 829967 - protein, 464 aa, Homo sapiens
RAHARSPLTQPTWLQWSTLWRMLGLSCGMRLCRYGELPPGRERSGLAAPPGVRGVARSVAWCGWVCAGAFCPQDIGKNIYTIREVVTEIRDKATRRRLAVLPYELRFKEPLPEYVRLVTEFSKKTGDYPSLSATDIQVLALTYQLEAEFVGVSHLKQEPQKVKVSSSIQHPETPLHISGFHLPYKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTVSDDGTLHMHFSRNPKVLNPRGLRYSLPTPKGGKYAINPHLTEDQRFPQLRLSQKARQKTNVFAPDYIAGVSPFVENDISSRSATLQVRDSTLGAGRRRLNPNASRKKFVKKR

SEQ ID NO: 829968 - protein, 352 aa, Homo sapiens
CACALPSHAANMAPVEHVVADAGAFLRHAALQDIGKNIYTIREVVTEIRDKATRRRLAVLPYELRFKEPLPEYVRLVTEFSKKTGDYPSLSATDIQVLALTYQLEAEFVGVSHLKQEPQKVKVSSSIQHPETPLHISGFHLPYKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTVSDDGTLHMHFSRNPKVLNPRGLRYSLPTPKGGKYAINPHGL

SEQ ID NO: 829969 - protein, 380 aa, Homo sapiens
RAHARSPLTQPTWLQWSTLWRMLGLSCGMRLCRTSGRTFTPSGRWSLRFGTRPHAGGSLSCPTSCGSRSPYRNTCGWVKVSSSIQHPETPLHISGFHLPYKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTVSDDGTLHMHFSRNPKVLNPRGLRYSLPTPKGGKYAINPHLTEDQRFPQLRLSQKARQKTNVFAPDYIAGVSPFVENDISSRSATLQVRDSTLGAGRRRLNPNASRKKFVKKR

SEQ ID NO: 829970 - protein, 440 aa, Homo sapiens
RAHARSPLTQPTWLQWSTLWRMLGLSCGMRLCRYGELPPGRERSGLAAPPGVRGVARSVAWCGWVCAGAFCPQDIGKNIYTIREVVTEIRDKATRRRLAVLPYELRFKEPLPEYVRLVTEFSKKTGDYPSLSATDIQVLALTYQLEAEFVGVSHLKQEPQKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTVSDDGTLHMHFSRNPKVLNPRGLRYSLPTPKGGKYAINPHLTEDQRFPQLRLSQKARQKTNVFAPDYIAGVSPFVENDISSRSATLQVRDSTLGAGRRRLNPNASRKKFVKKR

SEQ ID NO: 829971 - protein, 672 aa, Homo sapiens
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSI

SEQ ID NO: 829972 - protein, 729 aa, Homo sapiens
MFSLSSTVQPQVTVPLSHLINAFHTPKNTSVSLSGVSVSQNQHRDVVPEHEAPSSECMFSDFLTKLNIVSIGKGKIFEGYRSMFMEPAKRMKKSLDTTDNWHIRPEPFSLSIPPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSI

SEQ ID NO: 829973 - protein, 289 aa, Homo sapiens
MFSLSSTVQPQVTVPLSHLINAFHTPKNTSVSLSGVSVSQNQHRDVVPEHEAPSSEGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKDSLVGPQAGKNLLAELGGRTDVLYMRRKRSGDRLGGWEQPDQKTLSSQGDAHGVNNGDTQTGGEQKRPTGSLNGQRNTVRTHEVTQQSTQRPNRGKA

SEQ ID NO: 829974 - protein, 672 aa, Homo sapiens; identical to SEQ ID NO: 829971

SEQ ID NO: 829975 - protein, 672 aa, Homo sapiens; identical to SEQ ID NO: 829971

SEQ ID NO: 829976 - protein, 672 aa, Homo sapiens; identical to SEQ ID NO: 829971

SEQ ID NO: 829977 - protein, 672 aa, Homo sapiens; identical to SEQ ID NO: 829971

SEQ ID NO: 829978 - protein, 258 aa, Homo sapiens
MNIDDLSINSPSALQILPGSPYGRLDSATLTSAQGRQLKGLESEKTLALNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSI

SEQ ID NO: 829979 - protein, 729 aa, Homo sapiens; identical to SEQ ID NO: 829972

SEQ ID NO: 829980 - protein, 136 aa, Homo sapiens
MFSLSSTVQPQVTVPLSHLINAFHTPKNTSVSLSGVSVSQNQHRDVVPEHEAPSSECMFSDFLTKLNIVSIGKGKIFEGYRSMFMEPAKRMKKSLDTTDNWHIRPEPFSLSIPVHCGFLQMPIVYDLFCPSFLVTA

SEQ ID NO: 829981 - protein, 672 aa, Homo sapiens; identical to SEQ ID NO: 829971

SEQ ID NO: 829982 - protein, 672 aa, Homo sapiens; identical to SEQ ID NO: 829971

SEQ ID NO: 829983 - protein, 605 aa, Homo sapiens
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHLGVMTYSDTGKLSPETQSAIEQEIRILLRDSI

SEQ ID NO: 829984 - protein, 665 aa, Homo sapiens
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEYK

SEQ ID NO: 829985 - protein, 508 aa, Homo sapiens
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWTPYERAKHILKTHAKEHKNLAEALLTYETLDAKEIQIVLEGKKLEVR

SEQ ID NO: 829986 - protein, 418 aa, Homo sapiens
MQYHKLTEHFDEKPFSCEECGAKFAANSTLKNHLRLHTGDRPFMCKHCLMTFTQASALAYHTKKKHSEGKMYACQYCDAVFAQSIELSRHVRTHTGDKPYVCRDCGKGFRQANGLSIHLHTFHNIEDPYDCKKCRMSFPTLQDHRKHIHEVHSKEYHPCPTCGKIFSAPSMLERHMVTHVGGKPFSCGICNKAYQQLSGLWYHNRTHHPDVFAAQNHRSSKFSSLQCSSCDKTFPNTIEHKKHIKAEHADMKFHECDQCKELFPTPALLQVHVKCQHSGSQPFRCLYCAATFRFPGALQHHVTTEHFKQSETTFPCELCGELFTSQAQLDSHLESEHPKVMSTETQAAASQMAQVIQTPEPVAPTEQVITLEETQLAGSQVFVTLPDSQASQASSELVAVTVEDLLDGTVTLICGEAK

SEQ ID NO: 829987 - protein, 502 aa, Homo sapiens
CKACDKSFHFYCRLKVHMKRCRVAKSKQVQCKECSETKDSKKELDKHQLEAHGAGGEPDAPKKKKKRLPVTCDLCGREFAHASGMQYHKLTEHFDEKPFSCEECGAKFAANSTLKNHLRLHTGDRPFMCKHCLMTFTQASALAYHTKKKHSEGKMYACQYCDAVFAQSIELSRHVRTHTGDKPYVCRDCGKGFRQANGLSIHLHTFHNIEDPYDCKKCRMSFPTLQDHRKHIHEVHSKEYHPCPTCGKIFSAPSMLERHMVTHVGGKPFSCGICNKAYQQLSGLWYHNRTHHPDVFAAQNHRSSKFSSLQCSSCDKTFPNTIEHKKHIKAEHADMKFHECDQCKELFPTPALLQVHVKCQHSGSQPFRCLYCAATFRFPGALQHHVTTEHFKQSETTFPCELCGELFTSQAQLDSHLESEHPKVMSTETQAAASQMAQVIQTPEPVAPTEQVITLEETQLAGSQVFVTLPDSQASQASSELVAVTVEDLLDGTVTLICGEAK

SEQ ID NO: 829988 - protein, 463 aa, Homo sapiens
CKACDKSFHFYCRLKVHMKRCRVAKSKQVQCKECSETKDSKKELDKHQLEAHGAGGEPDAPKKKKKRLPVTCDLCGREFAHASGMQYHKLTEHFDEKPFSCEECGAKFAANSTLKNHLRLHTGDRPFMCKHCLMTFTQASALAYHTKKKHSEGKMYACQYCDAVFAQSIELSRHVRTHTGDKPYVCRDCGKGFRQANGLSIHLHTFHNIEDPYDCKKCRMSFPTLQDHRKHIHEVHSKEYHPCPTCGKIFSAPSMLERHMVTHVGGKPFSCGICNKAYQQLSGLWYHNRTHHPDVFAAQNHRSSKFSSLQCSSCDKTFPNTIEHKKHIKAEHADMKFHECDQCKELFPTPALLQVHVKCQHSGSQPFRCLYCAATFRFPGALQHHVTTEHFKQSETTFPCELCGELFTSQAQLDSHLESEHPKVMSTETQAAASQMAQFGGDPACRVAGVCDVARFSGISGQL

SEQ ID NO: 829989 - protein, 149 aa, Homo sapiens
MGPTSAPDTAALVAHPPSLLMPGWFFPSLLMPLDSGEAQGRGDRHWPLSPEFLGGTQPHSSASICLTRGPLCAHSTGQCGGSLEATALFQSPCQSRGTRCLGAGRAGTDVFWGHQKALVSPQIVTVRTQCCYGQDSFPYAASASDLGGP

SEQ ID NO: 829990 - protein, 439 aa, Homo sapiens [sequence omitted]

SEQ ID NO: 829991 - protein, 439 aa, Homo sapiens [sequence omitted]

SEQ ID NO: 829992 - protein, 185 aa, Homo sapiens [sequence omitted]

SEQ ID NO: 829993 - protein, 460 aa, Homo sapiens
MTVEQKFGLFSAEIKEADPLAASEASQPKPCPPEVTPHYIWIDFLVQRFEIAKYCSSDQVEIFSSLLQRSMSLNIGRAKGSMNRHVAAIGPRFKLLTLGLSLLHADVVPNATIRNVLREKIYSTAFDYFSCPPKFPTQGEKRLREDISIMIKFWTAMFSDKKYLTASQLVPPADIGDLLEQLVEENTGSLSGPAKDFYQREFDFFNKITNVSAIIKPYPKGDERKKACLSALSEVTVQPGCSLPSNPEAIVLDVDYKSGTPMQSAAKAPYLAKFKVKRCGVSELEKEGLRCRSDSEDECSTQEADGQKISWQAAIFKLGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIGQPATAPPSSPFTPAPRGG

SEQ ID NO: 829994 - protein, 529 aa, Homo sapiens
MTVEQKFGLFSAEIKEADPLAASEASQPKPCPPEVTPHYIWIDFLVQRFEIAKYCSSDQVEIFSSLLQRSMSLNIGRAKGSMNRHVAAIGPRFKLLTLGLSLLHADVVPNATIRNVLREKIYSTAFDYFSCPPKFPTQGEKRLREDISIMIKFWTAMFSDKKYLTASQLVPPADIGDLLEQLVEENTGSLSGPAKDFYQREFDFFNKITNVSAIIKPYPKGDERKKACLSALSEVTVQPGCSLPSNPEAIVLDVDYKSGTPMQSAAKAPYLAKFKVKRCGVSELEKEGLRCRSDSEDECSTQEADGQKISWQAAIFKLGDDCRQDMLALQIIDLFKNIFQLVGLDLFVFPYRVVATAPGCGVIECIPDCTSRDQLGRQTDFGMYDYFTRQYGDESTLAFQQDFGFMFESSPGGNLGWEPDIKLTDEMVMIMGGKMEATPFKWFMEMCVRGYLAVRPYMDVVVSLVTIMLDTGLPCFRGQTIKFLKHRFSPNMTEREAANFIMKVIQSCFLSNRSRTYNMIQYYQNDIPY

SEQ ID NO: 829995 - protein, 439 aa, Homo sapiens [sequence omitted]

SEQ ID NO: 829996 - protein, 148 aa, Homo sapiens
RAGKRVHKVNLAPGQAPALTGSGLPHRLLTLGLSLLHADVVPNATIRNVLREKIYSTAFDYFRYSPKMCCAASRDGPAPPSAPSPQTPRKSLTGIHSCPVVLTNLLLQYPWPCGFKYLSALCMCPVYLELASQRDVGKFSLSSTDLGD

SEQ ID NO: 829997 - protein, 42 aa, Homo sapiens
MTEREAANFIMKVIQSCFLSNRSRTVLIAQAGVQWRDLGSPT

SEQ ID NO: 829998 - protein, 439 aa, Homo sapiens [sequence omitted]

SEQ ID NO: 829999 - protein, 290 aa, Homo sapiens
MIKFWTAMFSDKKYLTASQLVPPADIGDLLEQLVEENTGSLSGPAKDFYQREFDFFNKITNVSAIIKPYPKGDERKKACLSALSEVTVQPGCSLPSNPEAIVLDVDYKSGTPMQSAAKAPYLAKFKVKRCGVSELEKEGLRCRSDSEDECSTQEADGQKISWQAAIFKLGDDCRQDMLALQIIDLFKNIFQLVGLDLFVFPYRVVATAPGCGVIECIPDCTSRDQLGRQTDFGMYDYFTRQYGDESTLAFQQVARVATGRGKSCVLHPTPATHTQPLPTPCSPQSSFVKG

SEQ ID NO: 830000 - protein, 569 aa, Homo sapiens
MTVEQKFGLFSAEIKEADPLAASEASQPKPCPPEVTPHYIWIDFLVQRFEIAKYCSSDQVEIFSSLLQRSMSLNIGRAKGSMNRHVAAIGPRFKLLTLGLSLLHADVVPNATIRNVLREKIYSTAFDYFSCPPKFPTQGEKRLREDISIMIKFWTAMFSDKKYLTASQLVPPADIGDLLEQLVEENTGSLSGPAKDFYQREFDFFNKITNVSAIIKPYPKGDERKKACLSALSEVTVQPGCSLPSNPEAIVLDVDYKSGTPMQSAAKAPYLAKFKVKRCGVSELEKEGLRCRSDSEDECSTQEADGQKISWQAAIFKLGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDVVVSLVTIMLDTGLPCFRGQTIKFLKHRFSPNMTEREAANFIMKVIQSCFLSNRSRTYNMIQYYQNDIPY

SEQ ID NO: 830001 - protein, 439 aa, Homo sapiens [sequence omitted]

SEQ ID NO: 830002 - protein, 371 aa, Homo sapiens
MTVEQKFGLFSAEIKEADPLAASEASQPKPCPPEVTPHYIWIDFLVQRFEIAKYCSSDQVEIFSSLLQRSMSLNIGRAKGSMNRHVAAIGPRFKLLTLGLSLLHADVVPNATIRNVLREKIYSTAFDYFSCPPKFPTQGEKRLREDISIMIKFWTAMFSDKKYLTASQLVPPADIGDLLEQLVEENTGSLSGPAKDFYQREFDFFNKITNVSAIIKPYPKGDERKKACLSALSEVTVQPGCSLPSNPEAIVLDVDYKSGTPMQSAAKAPYLAKFKVKRCGVSELEKEGLRCRSDSEDECSTQEADGQKISWQAAIFKLGDDCRQVSRVRPQVGLGTGLAAPQGSRPTRVQSHMQKCESFPSLTWFRCHGVN

SEQ ID NO: 830003 - protein, 660 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 830004 - protein, 67 aa, Homo sapiens
SDGFLWCSTTYNFEKDGKYGFCPQNGQRVGSAIPEHLLWLPQGELQPVCAEGHTKEDAEVLWTAPDR

SEQ ID NO: 830005 - protein, 584 aa, Homo sapiens
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 830006 - protein, 584 aa, Homo sapiens; identical to SEQ ID NO: 830005

SEQ ID NO: 830007 - protein, 626 aa, Homo sapiens
QPGLGVQWGNARVAATSASWVQVILWPQSPEELGFTGTRRHAWLIFVFLVETGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 830008 - protein, 477 aa, Homo sapiens
AAIEGVQVLHCQLFVRFGGDIAGELDDGRRRGGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 830009 - protein, 660 aa, Homo sapiens; identical to SEQ ID NO: 830003

SEQ ID NO: 830010 - protein, 660 aa, Homo sapiens; identical to SEQ ID NO: 830003

SEQ ID NO: 830011 - protein, 660 aa, Homo sapiens; identical to SEQ ID NO: 830003

SEQ ID NO: 830012 - protein, 660 aa, Homo sapiens; identical to SEQ ID NO: 830003

SEQ ID NO: 830013 - protein, 590 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWR

SEQ ID NO: 830014 - protein, 378 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSVPAAASCRS

SEQ ID NO: 830015 - protein, 201 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPVHST

SEQ ID NO: 830016 - protein, 260 aa, Homo sapiens
KGKYEAWVLSWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPLAFHCWLP

SEQ ID NO: 830017 - protein, 131 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKRGWGKARRSRQLLVKGQYLEKSEYDFVQHASL

SEQ ID NO: 830018 - protein, 243 aa, Homo sapiens
CRDPGQNTKKQTCYYFFKDDYFAKKNEERKQNKVEAKLRAKQEQEAKQKLEEDAIWGFKHTKGLAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWGSIGRMGNTPFNLREPGTSLGLHWPFRPQ

SEQ ID NO: 830019 - protein, 660 aa, Homo sapiens; identical to SEQ ID NO: 830003

SEQ ID NO: 830020 - protein, 698 aa, Homo sapiens
CRDPGQNTKKQTCYYFFKDDYFAKKNEERKQNKVEAKLRAKQEQEAKQKLEEDAIWGFKHTKGLAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 830021 - protein, 495 aa, Homo sapiens
KGKYEAWVLSWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 830022 - protein, 485 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIPDNLDAVVDLQGGGHSYFFKGAYYLKLENQSLKSVKFGSIKSDWLGC

SEQ ID NO: 830023 - protein, 660 aa, Homo sapiens; identical to SEQ ID NO: 830003

SEQ ID NO: 830024 - protein, 147 aa, Homo sapiens
RVVPITFHLHGFWFSCSVLPSFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 830025 - protein, 660 aa, Homo sapiens; identical to SEQ ID NO: 830003

SEQ ID NO: 830026 - protein, 642 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLEN

SEQ ID NO: 830027 - protein, 425 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPLAFHCWLP

SEQ ID NO: 830028 - protein, 284 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGLRLSTAVEASSSFFLSLGSLHSSFSIWVV

SEQ ID NO: 830029 - protein, 117 aa, Homo sapiens
GRALRVDVEARSSRRPGKRGGERKKEEKSGGGRVGGWGREGRARVRPPPPAPLCQLPPSPAGYIWRLPSLVSAASRLPQAVAGGCASGALNIQRDCQDLRRRRRRRGLGRGGRTMSR

SEQ ID NO: 830030 - protein, 201 aa, Homo sapiens
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLPPGLTCRDLQEANHFQGRIENPFSPR

SEQ ID NO: 830031 - protein, 412 aa, Homo sapiens
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSVDSSVLLQALKPIPPLNLETKD

SEQ ID NO: 830032 - protein, 406 aa, Homo sapiens
SQWSLVHAVDIVDHASRRPSRMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSVDSSVLLQALKPIPPLNLETKD

SEQ ID NO: 830033 - protein, 502 aa, Homo sapiens
MERIPSAQPPPACLPKAPGLEHGDLPGMYPAHMYQVYKSRRGIKRSEDSKVSKCTPRDPALSPSRALSFQEKFSRFEVGEGMQGVGSVPLLSDLEKKGQTMVLGATLLLCSSAGLLLRGWEDRLLISFPKLPTASPCVLQETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSVDSSVLLQALKPIPPLNLETKD

SEQ ID NO: 830034 - protein, 412 aa, Homo sapiens; identical to SEQ ID NO: 830031

SEQ ID NO: 830035 - protein, 272 aa, Homo sapiens
MFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSVDSSVLLQALKPIPPLNLETKD

SEQ ID NO: 830036 - protein, 412 aa, Homo sapiens; identical to SEQ ID NO: 830031

SEQ ID NO: 830037 - protein, 408 aa, Homo sapiens
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSDTLFLYISSLLSKVPSSI

SEQ ID NO: 830038 - protein, 592 aa, Homo sapiens
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHTHTNRHRHTSLTLSLSPLPPLDVNVENKRDTHTHTRLMMTADVATTKELGAHVRAHEKNHDDSGAREDRPTTPNSAATTATHHALLTNSKRSTRNHAAASYKTSQQTEKHTQPPTSHPLLTNVNAQRGTTLTKTNRHTTPHPHNTQTKRWRMRTSTPSAANSHTTAGHPQQQQTKRDNPTRTIRGDNTKSEQQRTHHYTRTPTNQTTPTHKRDRTETRRTCHTHCTPRTRGGQHERKNTHTTNNPTTTQKASQQTTTGREARQPIKRGQTTLDPH

SEQ ID NO: 830039 - protein, 130 aa, Homo sapiens
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGEC

SEQ ID NO: 830040 - protein, 164 aa, Homo sapiens
MERIPSAQPPPACLPKAPGLEHGDLPGMYPAHMYQVYKSRRGIKRSEDSKVSKCTPRDPALSPSRALSFQEKFSRFEVGEGMQGVGSVPLLSDLEKKGQTMVLGATLLLCSSAGLLLRGWEDRLLISFPKRPPPPRASCRRPTNCRTGSSRKRDVTGLTSASPS

SEQ ID NO: 830041 - protein, 412 aa, Homo sapiens; identical to SEQ ID NO: 830031

SEQ ID NO: 830042 - protein, 169 aa, Homo sapiens
RPPLTRSLPPPRPPHFSFTWLARRRQTAQGAHTASLCAESEPEAAGTPGHARPQLKLHLKAEDSSSPGDFKELRLRGTSAERPPKPSPGQSSSRRSASADRSAQWPRLAAPWSGSPARNHPPSPGVFWLTHANEARTTWTSPSWLQHQLAFLFRSLTSGDFQDSLVFLT

SEQ ID NO: 830043 - protein, 412 aa, Homo sapiens; identical to SEQ ID NO: 830031

SEQ ID NO: 830044 - protein, 412 aa, Homo sapiens; identical to SEQ ID NO: 830031

SEQ ID NO: 830045 - protein, 412 aa, Homo sapiens; identical to SEQ ID NO: 830031

SEQ ID NO: 830046 - protein, 272 aa, Homo sapiens; identical to SEQ ID NO: 830035

SEQ ID NO: 830047 - protein, 412 aa, Homo sapiens; identical to SEQ ID NO: 830031

SEQ ID NO: 830048 - protein, 412 aa, Homo sapiens; identical to SEQ ID NO: 830031

SEQ ID NO: 830049 - protein, 147 aa, Homo sapiens
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDHSAAAFQNALCLIADRVLTFSFPVFILVLSRCLYL

SEQ ID NO: 830050 - protein, 164 aa, Homo sapiens; identical to SEQ ID NO: 830040

SEQ ID NO: 830051 - protein, 117 aa, Homo sapiens
AAGTPGHARPQLKLHLKAEDSSSPGDFKELRLRGTSAERPPKPSPGQSSSRRSASADRSAQWPRLAAPWSGSPARNHPPPACPKHRDWSTETYQGKLALLGPSSLNCSPMLCATLNL

SEQ ID NO: 830052 - protein, 708 aa, Homo sapiens
MNYPSPPPTPTHRHPTDTLKIEILTVEPSNVTVFGDGAFKKVNEDKMKSYGWTPIPYEWFPLKEIRTQTHRKVRPCEDTGGRWPSTSQRDLQALEETNTADTLILDFKKCEKINFCSLNYPICDDFAMEALVNLYGFWYWESGVLVELIPKNVELALELDNGKRPEEVFVRKSIDCLEEIVGRHMDVEGDSGEDLENRRAVEKASVILEVYICHLESNIGRNMNVKGVSGEELKQMRNILLETEEKGNAYYNVANSQIVFCGKWMNLQSDELECLAEISKQCIKDMAWFLLAAESKMQEEREKFKKELLSQKQPEPEDSENSQSIHIAKIQHVLEGTSKLLQDNHFLKQLGICDLWIQSAILAATSRSQDRDGGYTYGNAAGWYRREQRDKNEGSLLDFLRFYKMGQKSYLAVNMCSSRRGKNDPEDDGEGKGATIATTGPEGSGLRSQGRLLLRAEGGGLPHWWAQKTGLPPLLGGKMENEAEEDYSGALKSNGICLYTFQTCLGSITLLSDFFGIGMFILCLSHQWCILEANNLSSFTGSCWRRILPQGETLSMPVPDLNDIEMDLGLRVDTEVGQDFGAVGMEWMCFVSEKDMNFEGPDGRILGVELYALQMYKVKVLTPSTKNVTIFGDGAFKKVIKIKCRYTYEPYIQYEWCLCKRLGQTQREDHVMTLEKEGHLQTEEGGLRRDKPCGHLNLGHLAFRSVGK

SEQ ID NO: 830053 - protein, 211 aa, Homo sapiens
LPQSGTFLSQIAIRVCLFSFQIPGTSSVVQRKWKPLQPVSQPRGPGQPTKSRMSAVAAEIKQIRARRKTARMLMVVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 830054 - protein, 444 aa, Homo sapiens
MSGTKLEDSPPCRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVIIWIVSCIIMIPQAIVMECSTVFPGLANKTTLFTVCDERWGGEIYPKMYHICFFLVTYMAPLCLMVLAYLQIFRKLWCRQIPGTSSVVQRKWKPLQPVSQPRGPGQPTKSRMSAVAAEIKQIRARRKTARMLMVVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 830055 - protein, 288 aa, Homo sapiens
MGESSEDIDQMFSTLLGEMDLLTQSLGVDTLPPPDPNPPRAEFNYSVGFKDLNESLNALEDQDLDALMADLVADISEAEQRTIQAQKESLQNQHHSASLQASIFSGAASLGYGTNVAATGISQYEDDLPPPPADPVLDLPLPPPPPEPLSQEEEEAQAKADKIKLALEKLKEAKVKKLVVKVHMNDNSTKSLMVDERQLARDVLDNLFEKTHCDCNVDWCLYEIYPELQIERFFEDHENVVEVLSDWTRDTENKILFLEKEFRRSPSISSISAVMTQEPLTSGSWEYG

SEQ ID NO: 830056 - protein, 342 aa, Homo sapiens
MGESSEDIDQMFSTLLGEMDLLTQSLGVDTLPPPDPNPPRAEFNYSVGFKDLNESLNALEDQDLDALMADLVADISEAEQRTIQAQKESLQNQHHSASLQASIFSGAASLGYGTNVAATGISQYEDDLPPPPADPVLDLPLPPPPPEPLSQEEEEAQAKADKIKLALEKLKEAKVKKLVVKVHMNDNSTKSLMVDERQLARDVLDNLFEKTHCDCNVDWCLYEIYPELQIERFFEDHENVVEVLSDWTRDTENKILFLEKEEKYAVFKNPQNFYLDNRGKKESKETNEKMNAKNKESLLEESFCGTSIIVPELEGALYLKEDGKKSWKRRYFLLRASGIYYV

SEQ ID NO: 830057 - protein, 209 aa, Homo sapiens
MGESSEDIDQMFSTLLGEMDLLTQSLGVDTLPPPDPNPPRAEFNYSVGFKDLNESLNALEDQDLDALMADLVADISEAEQRTIQAQKESLQNQHHSASLQASIFSGAASLGYGTNVAATGISQYEDDLPPPPADPVLDLPLPPPPPEPLSQLVVKVHMNDNSTKSLMVDERQLARDVLDNLFEKTHCDCNVDWCLYEIYPELQIEFLLG

SEQ ID NO: 830058 - protein, 427 aa, Homo sapiens
MGESSEDIDQMFSTLLGEMDLLTQSLGVDTLPPPDPNPPRAEFNYSVGFKDLNESLNALEDQDLDALMADLVADISEAEQRTIQAQKESLQNQHHSASLQASIFSGAASLGYGTNVAATGISQYEDDLPPPPADPVLDLPLPPPPPEPLSQEEEEAQAKADKIKLALEKLKEAKVKKLVVKVHMNDNSTKSLMVDERQLARDVLDNLFEKTHCDCNVDWCLYEIYPELQIERFFEDHENVVEVLSDWTRDTENKILFLEKEFKKESQYIKYLCCDDTRTLNQWVMGIRIAKYGKTLYDNYQRAVAKAGLASRWTNLGTVNAAAPAQPSTGPKTGTTQPNGQIPQATHSVSAVLQEAQRHAETSKDKKPALGNHHDPAVPRAPHAPKSSLPPPPPVRRSSDTSGSPATPLKAKGTGGGGLPAPPDDFL

SEQ ID NO: 830059 - protein, 315 aa, Homo sapiens
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQMEPKVVTDTDETELARQMERLERENAEVDGDDDAEEMEAKAED

SEQ ID NO: 830060 - protein, 315 aa, Homo sapiens; identical to SEQ ID NO: 830059

SEQ ID NO: 830061 - protein, 315 aa, Homo sapiens; identical to SEQ ID NO: 830059

SEQ ID NO: 830062 - protein, 315 aa, Homo sapiens; identical to SEQ ID NO: 830059

SEQ ID NO: 830063 - protein, 302 aa, Homo sapiens
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQMEPKVVTDTDETELARQMERLERENAEVDS

SEQ ID NO: 830064 - protein, 229 aa, Homo sapiens
GVVYRGWHTQTVKTTFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQMEPKVVTDTDETELARQMERLERENAEVDGDDDAEEMEAKAED

SEQ ID NO: 830065 - protein, 303 aa, Homo sapiens
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQMEPKVVTDTDETELARQMERLERENAEVDWL

SEQ ID NO: 830066 - protein, 196 aa, Homo sapiens
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRAERA

SEQ ID NO: 830067 - protein, 315 aa, Homo sapiens; identical to SEQ ID NO: 830059

SEQ ID NO: 830068 - protein, 315 aa, Homo sapiens; identical to SEQ ID NO: 830059

SEQ ID NO: 830069 - protein, 315 aa, Homo sapiens; identical to SEQ ID NO: 830059

SEQ ID NO: 830070 - protein, 315 aa, Homo sapiens; identical to SEQ ID NO: 830059

SEQ ID NO: 830071 - protein, 294 aa, Homo sapiens
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQMEPKVVTDTDETAYSGSSRSPH

SEQ ID NO: 830072 - protein, 216 aa, Homo sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDGPKDTSVEDALERTYVPCLKTLQEEVMEAMGIKETRKYKKVYWY

SEQ ID NO: 830073 - protein, 216 aa, Homo sapiens; identical to SEQ ID NO: 830072

SEQ ID NO: 830074 - protein, 152 aa, Homo sapiens
TPRKSTGVAGEGTLRAHVLKIRSAAESGGHYRYIGKTMDYRGTMIPSEAPLLHRQVKLVDPMDRKPTEIEWRFTEAGERVRVSTRSGRIIPKPEFPRADGIVPETWIDGPKDTSVEDALERTYVPCLKTLQEEVMEAMGIKETRKYKKVYWY

SEQ ID NO: 830075 - protein, 216 aa, Homo sapiens; identical to SEQ ID NO: 830072

SEQ ID NO: 830076 - protein, 216 aa, Homo sapiens; identical to SEQ ID NO: 830072

SEQ ID NO: 830077 - protein, 154 aa, Homo sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERMAPKTHQWKML

SEQ ID NO: 830078 - protein, 1125 aa, Homo sapiens
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 830079 - protein, 1125 aa, Homo sapiens; identical to SEQ ID NO: 830078

SEQ ID NO: 830080 - protein, 1481 aa, Homo sapiens
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGDWDINNPSSSNVIYDEQSPLPPSSHFASIFEESHVPVIEESLRVQICEKAEELKDIVPEKKSTLNENQPEIKHQSLLQKNVSKRDPPSSHGHSNKKNLLKVENGVTRRGRSVSPKKPASQHSEEHLDKIPSPLKNNPKRRPRDQSLSPSKGENKSCQVSTRAGSGQDQCRKSRGRSASPKKQQKIEGSKAPSNAEAKLLEGKSRRIAGYTGSNAEQIPDGKEKSDVIRKDAKQNQLEKSRTRSPEKKIKRMVEKSLPSKMTNKTTSKEVSENEKGKKVTTGETSSSNDKIGENVQLSEKRLKQEPEEKVVSNKTEDHKGKELEAADKNKETGRFKPESSSPVKKTLITPGPWKVPSGNKVTGTIGMAEKRQ

SEQ ID NO: 830081 - protein, 121 aa, Homo sapiens [sequence omitted]

SEQ ID NO: 830082 - protein, 1150 aa, Homo sapiens
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDFTLVAQAGVQWHDLGSLQPPPPGFNHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 830083 - protein, 1481 aa, Homo sapiens; identical to SEQ ID NO: 830080

SEQ ID NO: 830084 - protein, 560 aa, Homo sapiens
PRLARQDTNIQNLQELNNKQTKHNKKTTTKNLINSKHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGDWDINNPSSSNVIYDEQSPLPPSSHFASIFEESHVPVIEESLRVQICEKAEELKDIVPEKKSTLNENQPEIKHQSLLQKNVSKRDPPSSHGHSNKKNLLKVENGVTRRGRSVSPKKPASQHSEEHLDKIPSPLKNNPKRRPRDQSLSPSKGENKSCQVSTRAGSGQDQCRKSRGRSASPKKQQKIEGSKAPSNAEAKLLEGKSRRIAGYTGSNAEQIPDGKEKSDVIRKDAKQNQLEKSRTRSPEKKIKRMVEKSLPSKMTNKTTSKEVSENEKGKKVTTGETSSSNDKIGENVQLSEKRLKQEPEEKVVSNKTEDHKGKELEAADKNKETGRFKPESSSPVKKTLITPGPWKVPSGNKVTGTIGMAEKRQ

SEQ ID NO: 830085 - protein, 122 aa, Homo sapiens [sequence omitted]

SEQ ID NO: 830086 - protein, 203 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYVLGSAMSRPIIHFGSDYEDRYYRENMHRYPNQVYYRPMDEYSNQNNFVHDCVNITIKQHTVTTTTKGGELHRDRR

SEQ ID NO: 830087 - protein, 203 aa, Homo sapiens; identical to SEQ ID NO: 830086

SEQ ID NO: 830088 - protein, 203 aa, Homo sapiens; identical to SEQ ID NO: 830086

SEQ ID NO: 830089 - protein, 203 aa, Homo sapiens; identical to SEQ ID NO: 830086

SEQ ID NO: 830090 - protein, 203 aa, Homo sapiens; identical to SEQ ID NO: 830086

SEQ ID NO: 830091 - protein, 120 aa, Homo sapiens
MRTVTIVKTCTVTPTKCTTGPWMSTATRTTLCTTASISQSSSTRSPQPPRGENFTETDVKMMERVVEQMCITQYERGISGLLPERIEHGPLLLSTCDPPDLFPHLPDSGMRKVFLFSPSF

SEQ ID NO: 830092 - protein, 120 aa, Homo sapiens; identical to SEQ ID NO: 830091

SEQ ID NO: 830093 - protein, 256 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYVLGSAMSRPIIHFGSDYEDRYYRENMHRYPNQVYYRPMDEYSNQNNFVHDCVNITTPRGENFTETDVKMMERVVEQMCITQYERGISGLLPERIEHGPLLLSTCDPPDLFPHLPDSGMRKVFLFSPSF

SEQ ID NO: 830094 - protein, 110 aa, Homo sapiens
MVVAGGSLMVVAGGSPMVVAGDSLTGAVVGGLGGYVLGSAMSRPIIHFGSDYEDRYYRENMHRYPNQVYYRPMDEYSNQNNFVHDCVNITIKQHTVTTTTKGGELHRDRR

SEQ ID NO: 830095 - protein, 234 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMISAVTMRTVTIVKTCTVTPTKCTTGPWMSTATRTTLCTTASISQSSSTRSPQPPRGENFTETDVKMMERVVEQMCITQYERGISGLLPERIEHGPLLLSTCDPPDLFPHLPDSGMRKVFLFSPSF

SEQ ID NO: 830096 - protein, 120 aa, Homo sapiens
PKQVSVQGADWTEYRYKLETTGFYDATVSVSENIYRIQKLSSTGSYTPTQREGTRCDQQTVVKMMETADVLSDRCVSSQSKKEVHRRGSDYPDVGLAGMVLFSSPPVILLISFLIFLIVG

SEQ ID NO: 830097 - protein, 203 aa, Homo sapiens; identical to SEQ ID NO: 830086

SEQ ID NO: 830098 - protein, 203 aa, Homo sapiens; identical to SEQ ID NO: 830086

SEQ ID NO: 830099 - protein, 203 aa, Homo sapiens; identical to SEQ ID NO: 830086

SEQ ID NO: 830100 - protein, 203 aa, Homo sapiens; identical to SEQ ID NO: 830086

SEQ ID NO: 830101 - protein, 195 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQGGGTHSQWNKPSKPKTNMKHMAGAAAAGAVVGGLGGYVLGSAMSRPIIHFGSDYEDRYYRENMHRYPNQVYYRPMDEYSNQNNFVHDCVNITIKQHTVTTTTKGGELHRDRR

SEQ ID NO: 830102 - protein, 120 aa, Homo sapiens; identical to SEQ ID NO: 830091

SEQ ID NO: 830103 - protein, 203 aa, Homo sapiens; identical to SEQ ID NO: 830086

SEQ ID NO: 830104 - protein, 185 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYVLGSAMSRPIIHFGSDYEDRYYRGNQNNFVHDCVNITIKQHTVTTTTKGGELHRDRR

SEQ ID NO: 830105 - protein, 63 aa, Homo sapiens
IECQGDSSMASHDRQPRNKVFYPQIYSLAYEMLQSSLWGKLHSIEDSLFDFHFRETQDIKRYM

SEQ ID NO: 830106 - protein, 132 aa, Homo sapiens
MAEEGIAAGGVMDVNTALQEVLKTALIHDGLARGIREAAKALDKRQAHLCVQASNCDEPMYVKLVEALLAEHQINLIKVDDNKKLGEWVGLCKIDREGNPRKVVGCSCVVVKDYGKESQAKDVIEEYFKCKK

SEQ ID NO: 830107 - protein, 84 aa, Homo sapiens
SDAFILENNSVASTFFHETEAGKKQKSTKSSPSCHGVLACEDMGRLGAGGEAGQHWARGSVVVKDYGKESQAKDVIEEYFKCKK

SEQ ID NO: 830108 - protein, 132 aa, Homo sapiens; identical to SEQ ID NO: 830106

SEQ ID NO: 830109 - protein, 132 aa, Homo sapiens; identical to SEQ ID NO: 830106

SEQ ID NO: 830110 - protein, 132 aa, Homo sapiens; identical to SEQ ID NO: 830106

SEQ ID NO: 830111 - protein, 202 aa, Homo sapiens
MDPGRGGQKPRSHPGEERAARQGGQRNKDEAAAGARENAAEPTQRAQGGNRDEEDGGTARRKEGGAGETENTEGSSAEDKEGGTHGRETGGAAGRKERSRKRAGGGREAGDDMRGGGRATRERERGSRADEQGSRRRTSAAPGRRQAHRSSRGGGERIGEGTGKGRAGNLTNDEGTKQSRGKEEGEAGGEATRGERRGKQAT

SEQ ID NO: 830112 - protein, 132 aa, Homo sapiens; identical to SEQ ID NO: 830106

SEQ ID NO: 830113 - protein, 132 aa, Homo sapiens; identical to SEQ ID NO: 830106

SEQ ID NO: 830114 - protein, 132 aa, Homo sapiens; identical to SEQ ID NO: 830106

SEQ ID NO: 830115 - protein, 132 aa, Homo sapiens; identical to SEQ ID NO: 830106

SEQ ID NO: 830116 - protein, 132 aa, Homo sapiens; identical to SEQ ID NO: 830106

SEQ ID NO: 830117 - protein, 80 aa, Homo sapiens
MYVKLVEALCAEHQINLIKVDDNKKLGEWVGLCKIDREGKPRKVVGCSCVVVKDYGKESQAKDVIEEYFKCKNEDTNFRA

SEQ ID NO: 830118 - protein, 158 aa, Homo sapiens; identical to SEQ ID NO: 775677

SEQ ID NO: 830119 - protein, 158 aa, Homo sapiens; identical to SEQ ID NO: 775677

SEQ ID NO: 830120 - protein, 158 aa, Homo sapiens; identical to SEQ ID NO: 775677

SEQ ID NO: 830121 - protein, 158 aa, Homo sapiens; identical to SEQ ID NO: 775677

SEQ ID NO: 830122 - protein, 158 aa, Homo sapiens; identical to SEQ ID NO: 775677

SEQ ID NO: 830123 - protein, 158 aa, Homo sapiens; identical to SEQ ID NO: 775677

SEQ ID NO: 830124 - protein, 158 aa, Homo sapiens; identical to SEQ ID NO: 775677

SEQ ID NO: 830125 - protein, 158 aa, Homo sapiens; identical to SEQ ID NO: 775677

SEQ ID NO: 830126 - protein, 158 aa, Homo sapiens; identical to SEQ ID NO: 775677

SEQ ID NO: 830127 - protein, 158 aa, Homo sapiens; identical to SEQ ID NO: 775677

SEQ ID NO: 830128 - protein, 75 aa, Homo sapiens
NPPNTPIRSGAGVNRTRRMAEEGIAAGGVMDVNTALQEVLKTALIHDGLARGIREAAQSLRQAAKPIFVCACIQL

SEQ ID NO: 830129 - protein, 103 aa, Homo sapiens
ASLLLLNSRPSTLDKRQPILCVLASNCDEPMYVKLVEALCAEHQINLIKVDDNKKLGEWVGLCKIDREGKPRKVVGCSCVVVKDYGKESQAKDVIEEYFKCKK

SEQ ID NO: 830130 - protein, 81 aa, Homo sapiens
AGRVERLREDDQKGEALCAEHQINLIKVDDNKKLGEWVGLCKIDREGKPRKVVGCSCVVVKDYGKESQAKDVIEEYFKCKK

SEQ ID NO: 830131 - protein, 87 aa, Homo sapiens
MYVKLVEALCAEHQINLIKVDDNKKLGEWVGLCKIDREGKPRKVVGCSCVVVKDYGKESQAKDVIEEYFKCKNGRLCKNGRLCENGR

SEQ ID NO: 830132 - protein, 82 aa, Homo sapiens
MYVKLVEALCAEHQINLIKVDDNKKLGEWVGLCKIDREGKPRKVVGCSCVVVKDYRKEPHYEPPKVPHDAPHHEPPKEPHDE

SEQ ID NO: 830133 - protein, 158 aa, Homo sapiens; identical to SEQ ID NO: 775677

SEQ ID NO: 830134 - protein, 158 aa, Homo sapiens; identical to SEQ ID NO: 775677

SEQ ID NO: 830135 - protein, 158 aa, Homo sapiens; identical to SEQ ID NO: 775677

SEQ ID NO: 830136 - protein, 158 aa, Homo sapiens; identical to SEQ ID NO: 775677

SEQ ID NO: 830137 - protein, 158 aa, Homo sapiens; identical to SEQ ID NO: 775677

SEQ ID NO: 830138 - protein, 158 aa, Homo sapiens; identical to SEQ ID NO: 775677

SEQ ID NO: 830139 - protein, 158 aa, Homo sapiens; identical to SEQ ID NO: 775677

SEQ ID NO: 830140 - protein, 132 aa, Homo sapiens; identical to SEQ ID NO: 830106

SEQ ID NO: 830141 - protein, 132 aa, Homo sapiens; identical to SEQ ID NO: 830106

SEQ ID NO: 830142 - protein, 132 aa, Homo sapiens; identical to SEQ ID NO: 830106

SEQ ID NO: 830143 - protein, 132 aa, Homo sapiens; identical to SEQ ID NO: 830106

SEQ ID NO: 830144 - protein, 132 aa, Homo sapiens; identical to SEQ ID NO: 830106

SEQ ID NO: 830145 - protein, 132 aa, Homo sapiens; identical to SEQ ID NO: 830106

SEQ ID NO: 830146 - protein, 132 aa, Homo sapiens; identical to SEQ ID NO: 830106

SEQ ID NO: 830147 - protein, 913 aa, Homo sapiens [sequence omitted]

SEQ ID NO: 830148 - protein, 913 aa, Homo sapiens [sequence omitted]

SEQ ID NO: 830149 - protein, 758 aa, Homo sapiens
DSSGAYGCPSPHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 830150 - protein, 626 aa, Homo sapiens
MLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 830151 - protein, 522 aa, Homo sapiens
WDEQPEKQPPPPLLGGRPLPAGGKPLCAGSSEEAGPPEGLGTPICSRSLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 830152 - protein, 374 aa, Homo sapiens
NWDRVGMLIGRKLNTENQNLIGGEKNIHSSDEPGCDTGVYESEEDFYIIGLIDGLRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 830153 - protein, 211 aa, Homo sapiens
MEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 830154 - protein, 262 aa, Homo sapiens
DSSGAYGCPSPHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWYVLLFFFFVLPNSRHFISFKNKNSTYKLLKIDDLQFAF

SEQ ID NO: 830155 - protein, 758 aa, Homo sapiens; identical to SEQ ID NO: 830149

SEQ ID NO: 830156 - protein, 758 aa, Homo sapiens; identical to SEQ ID NO: 830149

SEQ ID NO: 830157 - protein, 713 aa, Homo sapiens
DSSGAYGCPSPHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 830158 - protein, 114 aa, Homo sapiens
AGYSAIVMTSRLRALGGRINNIRTSELPKEKTRSEVICSIHFLDGVVQTFKVTKQDTGQVLLDMVHNHLGVTEKEYFGLQHDDDSVDSPRWLEASKPIRKQLKGWCDLFISVEH

SEQ ID NO: 830159 - protein, 490 aa, Homo sapiens
GQHTGGTSRSWTPRSAWPLRLHLLSSSQRRMVHQKGLSPQLPQCMLQRSLILQLSECPPQRSPPPQLLQCPPQRSPPPQLLQCPPQRSPPPQLLQCPPQRSPPPQLLQCPPQRSPPPQLLQCPPQRSPPPQLLQCPPQRSPPPQLLQCPPQRSPPPQLLQCPPQRSPPPQLLQCPPQRSPPPQLLQCPPQRSPPPQLLQCPPQRSLPSQLLQCPPQRNPPPQLLQCPPPEESASPAAAVPTPAESASFAAVVATLEEPTSPAASVPTPAAMVATLEEFTSPAASVPTSEEPASLAAAVSNPEEPTSPAAAVPTLEEPTSSAAAVLTPEELSSPAASVPTPEEPASPAAAVSNLEEPASPAAAVPTPEVAAIPAASVPTPEVPAIPAAAVPPMEEVSPIGVPFLGVSAHTDSVPISEEGTPVLEEASSTGMWIKEDLDSLVFGIKEVTSTVLHGKVPLAATAGLNSDEVIVHFDSGKGLKSKVRFAGLTWW

SEQ ID NO: 830160 - protein, 794 aa, Homo sapiens
GDCSQTEGNGEECIERVTFSFAFNHELTDVTSGPEVEVLYESNLLTDEIHLESGNVTVNQENNSLTSMGNVVTCELSVEKVCDEDGEAKELDYQATLLEDQAPAHFHRNFPEQVFQDLQRKSPESEILSLHLLVEELRLNPDGVETVNDTKPELNVASSEGGEMERRDSDSFLNIFPEKQVTKAGNTEPVLEEWIPVLQRPSRTAAVPTVKDALDAALPSPEEGTSIAAVPAPEGTAVVAALVPFPHEDILVASIVSLEEEDVTAAAVSAPERATVPAVTVSVPEGTAAVAAVSSPEETAPAVAAAITQEGMSAVAGFSPEWAALAITVPITEEDGTPEGPVTPATTVHAPEEPDTAAVRVSTPEEPASPAAAVPTPEEPTSPAAAVPTPEEPTSPAAAVPPPEEPTSPAAAVPTPEEPTSPAAAVPTPEEPTSPAAAVPTPEEPTSPAAAVPTPEEPTSPAAAVPTPEEPTSPAAAVPTPEEPASPAAAVPTPEEPASPAAAVPTPEEPAFPAPAVPTPEESASAAVAVPTPEESASPAAAVPTPAESASFAAVVATLEEPTSPAASVPTPAAMVATLEEFTSPAASVPTSEEPASLAAAVSNPEEPTSPAAAVPTLEEPTSSAAAVLTPEELSSPAASVPTPEEPASPAAAVSNLEEPASPAAAVPTPEVAAIPAASVPTPEVPAIPAAAVPPMEEVSPIGVPFLGVSAHTDSVPISEEGTPVLEEASSTGMWIKEDLDSLVFGIKEVTSTVLHGKVPLAATAGLNSDEVIVHFDSGKGLKSKVRFAGLTWW

SEQ ID NO: 830161 - protein, 121 aa, Homo sapiens
MPSDRPFKQRRSFADRCKEVQQIRDQHPSKIPVIIERYKGEKQLPVLDKTKFLVPDHVNMSELVKIIRRRLQLNPTQAFFLLVNQHSMVSVSTPIADIYEQEKDEDGFLYMVYASQETFGF

SEQ ID NO: 830162 - protein, 121 aa, Homo sapiens; identical to SEQ ID NO: 830161

SEQ ID NO: 830163 - protein, 121 aa, Homo sapiens; identical to SEQ ID NO: 830161

SEQ ID NO: 830164 - protein, 121 aa, Homo sapiens; identical to SEQ ID NO: 830161

SEQ ID NO: 830165 - protein, 123 aa, Homo sapiens
MRFFSSPCGKAAVDPADRCKEVQQIRDQHPSKIPVIIERYKGEKQLPVLDKTKFLVPDHVNMSELVKIIRRRLQLNPTQAFFLLVNQHSMVSVSTPIADIYEQEKDEDGFLYMVYASQETFGF

SEQ ID NO: 830166 - protein, 87 aa, Homo sapiens
SGRLRGCRAASRSNSLVSTFTMEKRGFYESLAKVKPGNFKVQTVSPREPASKVTEQALLRPQSKNGPQEKDCDLVDLDDASLPVSDV

SEQ ID NO: 830167 - protein, 404 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSEHPPGPSESKHAFRPTNAAAATSHSTASRSNSLVSTFTMEKRGFYESLAKVKPGNFKVQTVSPREPASKVTEQALLRPQSKNGPQEKDCDLVDLDDASLPVSDV

SEQ ID NO: 830168 - protein, 334 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSMRQARRLSNPCIQRYTSRAGECSTYVGSHANVPS

SEQ ID NO: 830169 - protein, 334 aa, Homo sapiens; identical to SEQ ID NO: 830168

SEQ ID NO: 830170 - protein, 404 aa, Homo sapiens; identical to SEQ ID NO: 830167

SEQ ID NO: 830171 - protein, 404 aa, Homo sapiens; identical to SEQ ID NO: 830167

SEQ ID NO: 830172 - protein, 404 aa, Homo sapiens; identical to SEQ ID NO: 830167

SEQ ID NO: 830173 - protein, 200 aa, Homo sapiens [sequence omitted]

SEQ ID NO: 830174 - protein, 200 aa, Homo sapiens [sequence omitted]

SEQ ID NO: 830175 - protein, 87 aa, Homo sapiens; identical to SEQ ID NO: 830166

SEQ ID NO: 830176 - protein, 404 aa, Homo sapiens; identical to SEQ ID NO: 830167

SEQ ID NO: 830177 - protein, 334 aa, Homo sapiens; identical to SEQ ID NO: 830168

SEQ ID NO: 830178 - protein, 404 aa, Homo sapiens; identical to SEQ ID NO: 830167

SEQ ID NO: 830179 - protein, 404 aa, Homo sapiens; identical to SEQ ID NO: 830167

SEQ ID NO: 830180 - protein, 393 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSMRQARRLSNPCIQRYTSRAGECSTSIPPVLQNPNTLSVLPTQPPPPHIPQPLAATLWSQPLPWRSEDFTSLLPRSSQGTSRSRLSLQENQLPK

SEQ ID NO: 830181 - protein, 404 aa, Homo sapiens; identical to SEQ ID NO: 830167

SEQ ID NO: 830182 - protein, 356 aa, Homo sapiens
MPYVDRQNRICGFLDIEENENSGKFLRRYFILDTREDSFVWYMDNPQNLPSGSSRVGAIKLTYISKVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSEHPPGPSESKHAFRPTNAAAATSHSTASRSNSLVSTFTMEKRGFYESLAKVKPGNFKVQTVSPREPASKVTEQALLRPQSKNGPQEKDCDLVDLDDASLPVSDV

SEQ ID NO: 830183 - protein, 404 aa, Homo sapiens; identical to SEQ ID NO: 830167

SEQ ID NO: 830184 - protein, 334 aa, Homo sapiens; identical to SEQ ID NO: 830168

SEQ ID NO: 830185 - protein, 578 aa, Homo sapiens
MAEESRKPSAPSPPDQTPEEDLVIVKVEEDHGWDQESSLHESNPLGQEVFRLRFRQLRYQETLGPREALIQLRALCHQWLRPDLNTKEQILELLVLEQFLTILPEELQTLVKEHQLENGEEVVTLLEDLERQIDILGRPVSARVHGHRVLWEEVVHSASAPEPPNTQLQSEATQHKSPVPQESQERAMSTSQSPTRSQKGSSGDQEMTATLLTAGFQTLEKIEDMAVSLIREEWLLDPSQKDLCRDNRPENFRNMFSLGGETRSENRELASKQVISTGIQPHGETAAKCNGDVIRGLEHEEARDLLGRLERQRGNPTQERRHKCDECGKSFAQSSGLVRHWRIHTGEKPYQCNVCGKAFSYRSALLSHQDIHNKVKRYHCKECGKAFSQNTGLILHQRIHTGEKPYQCNQCGKAFSQSAGLILHQRIHSGERPYECNECGKAFSHSSHLIGHQRIHTGEKPYECDECGKTFRRSSHLIGHQRSHTGEKPYKCNECGRAFSQKSGLIEHQRIHTGERPYKCKECGKAFNGNTGLIQHLRIHTGEKPYQCNECGKAFIQRSSLIRHQRIHSGEKSESISV

SEQ ID NO: 830186 - protein, 578 aa, Homo sapiens; identical to SEQ ID NO: 830185

SEQ ID NO: 830187 - protein, 350 aa, Homo sapiens
RASVSVSNQRLLNNLPSFPIFCGPTTLGDPRLGGAPPGLSRSFRLPPLPAAMAELGLNEHHQNEVINYMRFARSKRGLRLKTVDSCFQDLKESRLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKEILRLQEENEKLKSRLKTIEIQATNALDEKSKLEKALQDLQLDQGNQKDFIKAQDLSNLENTVAALKSEFQKTLNDKTENQKSLEENLATAKHDLLRVQEQLHMAEKELEKKFQQTAAYRNMKEILTKKNDQIKDLRKRLAQYEPED

SEQ ID NO: 830188 - protein, 350 aa, Homo sapiens; identical to SEQ ID NO: 830187

SEQ ID NO: 830189 - protein, 345 aa, Homo sapiens
RASVSVSNQRLLNNLPSFPIFCGPTTLGDPRLGGAPPGLSRSFRLPPLPAAMAELGLNEHHQNEVINYMRFARSKRGLRLKTVDSCFQDLKESRLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKEILRLQEENEKLKSRLKTIEIQATNALDEKSKLEKALQDLQLDQGNQKDFIKAQDLSNLENTVAALKSEFQKTLNDKTENQKSLEENLATAKHDLLRVQEQLHMAEKELEKKFQQTAAYRNMKEILTKKNDQIKDLRKRLAQ

SEQ ID NO: 830190 - protein, 260 aa, Homo sapiens
RASVSVSNQRLLNNLPSFPIFCGPTTLGDPRLGGAPPGLSRSFRLPPLPAAMAELGLNEHHQNEVINYMRFARSKRGLRLKTVDSCFQDLKESRLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKEILRLQEENEKLKSRLKTIEIQATNALDEKSKLEKALQDLQLDQGNQKDFIKARLSN

SEQ ID NO: 830191 - protein, 159 aa, Homo sapiens
RASVSVSNQRLLNNLPSFPIFCGPTTLGDPRLGGAPPGLSRSFRLPPLPAAMAELGLNEHHQNEVINYMRFARSKRGLRLKTVDSCFQDLKESRLVEDTFTIDEVSEVLNGLQAVVHSEVESELINTAYTNVLLLRQLFAQAEKWYLKLQTDISELENR

SEQ ID NO: 830192 - protein, 159 aa, Homo sapiens; identical to SEQ ID NO: 830191

SEQ ID NO: 830193 - protein, 117 aa, Homo sapiens
LVHCNLCLPGSSNSPASASPVTGIIGACQHAWLIFIFLVETRFHHVGQAGLEHLNSGYLPASASQCAGITSVSHCAWPRNTLCSMLPTRTASLLSYPKTKRIVTQQAQNTPFCLQPL

SEQ ID NO: 830194 - protein, 110 aa, Homo sapiens
MARHFLQQRISYCNDYYNNNQCAMNHNQYYQSILIINNHNGYSNKTRNSPLSLLSPRGYPRHPSDIRPASSHMTKTSPHLNHIPNFSLIKRKPSPHSFNLIHHGRQFEVD

SEQ ID NO: 830195 - protein, 33 aa, Homo sapiens
MIACATQKLSPHRGGHEHSANTYLPTEDRSKKR

SEQ ID NO: 830196 - protein, 3677 aa, Homo sapiens
MEDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSGLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830197 - protein, 3681 aa, Homo sapiens
MSEVSSDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSGLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830198 - protein, 3690 aa, Homo sapiens
SLTHRVTSSSPSSTHDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSGLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830199 - protein, 2344 aa, Homo sapiens
MTEIILLIFFPAYFLNAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830200 - protein, 1230 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 830201 - protein, 1225 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830202 - protein, 1133 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 830203 - protein, 678 aa, Homo sapiens
LRSAFSCELGRRRRRRSTFGEPGGSGKLTPPLVPTLDRGALAAMREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 830204 - protein, 647 aa, Homo sapiens
LRSAFSCELGRRRRRRSTFGEPGGSGKLTPPLVPTLDRGALAAMREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830205 - protein, 383 aa, Homo sapiens
LRSAFSCELGRRRRRRSTFGEPGGSGKLTPPLVPTLDRGALAAMREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMET

SEQ ID NO: 830206 - protein, 3685 aa, Homo sapiens
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSGLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830207 - protein, 1230 aa, Homo sapiens; identical to SEQ ID NO: 830200

SEQ ID NO: 830208 - protein, 1230 aa, Homo sapiens; identical to SEQ ID NO: 830200

SEQ ID NO: 830209 - protein, 2400 aa, Homo sapiens
MEDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSGLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKLLLRLLLW

SEQ ID NO: 830210 - protein, 2400 aa, Homo sapiens; identical to SEQ ID NO: 830209

SEQ ID NO: 830211 - protein, 2400 aa, Homo sapiens; identical to SEQ ID NO: 830209

SEQ ID NO: 830212 - protein, 33 aa, Homo sapiens
MVWLPVLHRVAAAETAKHQAKCNICKECPIIGF

SEQ ID NO: 830213 - protein, 3685 aa, Homo sapiens; identical to SEQ ID NO: 830206

SEQ ID NO: 830214 - protein, 3562 aa, Homo sapiens
MKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSGLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830215 - protein, 2341 aa, Homo sapiens
MSARKLRNLSYKKAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830216 - protein, 665 aa, Homo sapiens
LRSAFSCELGRRRRRRSTFGEPGGSGKLTPPLVPTLDRGALAAMREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 830217 - protein, 1243 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 830218 - protein, 1105 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830219 - protein, 976 aa, Homo sapiens
GFLRIAMQQDQCCSARFKLKMLHRKTYHVKDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830220 - protein, 660 aa, Homo sapiens
LRSAFSCELGRRRRRRSTFGEPGGSGKLTPPLVPTLDRGALAAMREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 830221 - protein, 3685 aa, Homo sapiens; identical to SEQ ID NO: 830206

SEQ ID NO: 830222 - protein, 1230 aa, Homo sapiens; identical to SEQ ID NO: 830200

SEQ ID NO: 830223 - protein, 1342 aa, Homo sapiens
SSVPFLIGYNHSRTIDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 830224 - protein, 2400 aa, Homo sapiens; identical to SEQ ID NO: 830209

SEQ ID NO: 830225 - protein, 1217 aa, Homo sapiens
MEDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSGLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKVKKKKEKLSKTKEINGKRKKCNNA

SEQ ID NO: 830226 - protein, 55 aa, Homo sapiens
MAVEPTQIQLSKRWREIESKFAQFRRLNFAQIVSCYWQTHVCVCNYYSINRGLLI

SEQ ID NO: 830227 - protein, 391 aa, Homo sapiens
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 830228 - protein, 391 aa, Homo sapiens; identical to SEQ ID NO: 830227

SEQ ID NO: 830229 - protein, 391 aa, Homo sapiens; identical to SEQ ID NO: 830227

SEQ ID NO: 830230 - protein, 391 aa, Homo sapiens; identical to SEQ ID NO: 830227

SEQ ID NO: 830231 - protein, 391 aa, Homo sapiens; identical to SEQ ID NO: 830227

SEQ ID NO: 830232 - protein, 391 aa, Homo sapiens; identical to SEQ ID NO: 830227

SEQ ID NO: 830233 - protein, 397 aa, Homo sapiens
SLALVPAAGGRAVCLLLHRRHIVCVSRGESGRRRCRFHHRNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 830234 - protein, 255 aa, Homo sapiens
MYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 830235 - protein, 255 aa, Homo sapiens; identical to SEQ ID NO: 830234

SEQ ID NO: 830236 - protein, 255 aa, Homo sapiens; identical to SEQ ID NO: 830234

SEQ ID NO: 830237 - protein, 265 aa, Homo sapiens
WDSLKGTFMSINSKGPHNCPVIQVTVTSWSNKKLTLPSPSCGRSLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 830238 - protein, 137 aa, Homo sapiens
MKCWASVPTWPISHALFWSCRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 830239 - protein, 373 aa, Homo sapiens
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSEPQFEGQRDIHHAAVRLGQL

SEQ ID NO: 830240 - protein, 391 aa, Homo sapiens; identical to SEQ ID NO: 830227

SEQ ID NO: 830241 - protein, 391 aa, Homo sapiens; identical to SEQ ID NO: 830227

SEQ ID NO: 830242 - protein, 391 aa, Homo sapiens; identical to SEQ ID NO: 830227

SEQ ID NO: 830243 - protein, 391 aa, Homo sapiens; identical to SEQ ID NO: 830227

SEQ ID NO: 830244 - protein, 391 aa, Homo sapiens; identical to SEQ ID NO: 830227

SEQ ID NO: 830245 - protein, 391 aa, Homo sapiens; identical to SEQ ID NO: 830227

SEQ ID NO: 830246 - protein, 391 aa, Homo sapiens; identical to SEQ ID NO: 830227

SEQ ID NO: 830247 - protein, 391 aa, Homo sapiens; identical to SEQ ID NO: 830227

SEQ ID NO: 830248 - protein, 74 aa, Homo sapiens
PRSGPCGWRPSRVSPPPSPPYCLCEQRGERPPPLPLPPQFEENRSETRSYPQLLLNTVTARSPNIKSSFVRQPV

SEQ ID NO: 830249 - protein, 246 aa, Homo sapiens
KVRYSWREGLSAEIDLSLVVLPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKEVRVVG

SEQ ID NO: 830250 - protein, 499 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 830251 - protein, 499 aa, Homo sapiens; identical to SEQ ID NO: 830250

SEQ ID NO: 830252 - protein, 486 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVGRPSSGS

SEQ ID NO: 830253 - protein, 499 aa, Homo sapiens; identical to SEQ ID NO: 830250

SEQ ID NO: 830254 - protein, 468 aa, Homo sapiens
MAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCLPPSFAWLLPHSSNRAPP

SEQ ID NO: 830255 - protein, 387 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSAPSPAILCL

SEQ ID NO: 830256 - protein, 348 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLRVCSLDREEGGGAAGAGGTAWAFCGEAVLGVGWGRVAALPPSFAWLLPHSSNRAPP

SEQ ID NO: 830257 - protein, 302 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLPPPQLFYVCN

SEQ ID NO: 830258 - protein, 154 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQDLIPTSSPWPMPTRCCS

SEQ ID NO: 830259 - protein, 263 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDPAPLICMAPPPLKQ

SEQ ID NO: 830260 - protein, 250 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMMPSAGAGGGARRRRGRGRRGCRSSSWGLPRTLLGRRRVPSAGGAVSVGHAQLRSEADMSAAGLLARARASWSAAAPSTTR

SEQ ID NO: 830261 - protein, 499 aa, Homo sapiens; identical to SEQ ID NO: 830250

SEQ ID NO: 830262 - protein, 87 aa, Homo sapiens
FPHFDEVTVRHLAYTLPGVTKAFLEENNLDYIIRSHEVKAEGYEVAHGGRCVTVFSAPNYCWYVFAFPAQGLYQATGFCLGFCFAFL

SEQ ID NO: 830263 - protein, 499 aa, Homo sapiens; identical to SEQ ID NO: 830250

SEQ ID NO: 830264 - protein, 499 aa, Homo sapiens; identical to SEQ ID NO: 830250

SEQ ID NO: 830265 - protein, 499 aa, Homo sapiens; identical to SEQ ID NO: 830250

SEQ ID NO: 830266 - protein, 477 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQTEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 830267 - protein, 337 aa, Homo sapiens
LPLSLTPHPCAFPPEYPIFSPGLLVFVCVPCLCLLHDSSWSTVNSYPSPHLCPLPTSLSRPVPLRWPLFFQTEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 830268 - protein, 275 aa, Homo sapiens
GAESGLARGSAPWTERKEVEQLGLGAQPGHSVGRPSSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 830269 - protein, 94 aa, Homo sapiens
YQRRVAITAGAFRCLIAAIMGRMHAPGKGLSQSALPYRRSVPTWLKLTSDDVKEQIYKLAKKGLTPSQIGVILRDSHGVAQVRFVTGNKILRNS

SEQ ID NO: 830270 - protein, 94 aa, Homo sapiens; identical to SEQ ID NO: 830269

SEQ ID NO: 830271 - protein, 97 aa, Homo sapiens
NSRPRRREKTTEGAFRCLIAAIMGRMHAPGKGLSQSALPYRRSVPTWLKLTSDDVKEQIYKLAKKGLTPSQIGVILRDSHGVAQVRFVTGNKILRNS

SEQ ID NO: 830272 - protein, 186 aa, Homo sapiens
VCKVLLNMKYQLPIQVVFWIAFSSFASAAKPGPGTASVSLPCSLSVMTRVYRYLLHRTVKLHVVLIFLDLDRFGILSSGCEQEVLDFLNFAEAWRARRAGLWRGPGPFSPTYHPRDTHRKGLSQSALPYRRSVPTWLKLTSDDVKEQIYKLAKKGLTPSQIGVILRDSHGVAQVRFVTGNKILRNS

SEQ ID NO: 830273 - protein, 106 aa, Homo sapiens
MRGKEIIMWTKPTTPRAKERYTTPQPTRSGAHKNQHKAKRKEGTNEREGGRKQQTEGARRGAGRGGGEAKRETEAGRTARHEHKTNEGTQIFSTGDGQTNKNDNGG

SEQ ID NO: 830274 - protein, 137 aa, Homo sapiens
MGGGAPKKPPGGPLPPPFLGKGPPGAKKTDRRGSQKPGERGNKAAWGSWRNPIGARGQTGDHPQVNGPANKGGACQTAFCGGEFWVHNKRVYEIQVALSIRDPSQHYLLRHAICTSVHIRRSHRTLLCSKSTLSTAS

SEQ ID NO: 830275 - protein, 96 aa, Homo sapiens
VSTQSAHYGRGLSLPDRRHHGSHACSRVSSGHQAGLLGGGWEEDRECGQRAEGMMFWAALALAATSPRDCFSPQEGPVPVGFTLSTQRPHLVEVDI

SEQ ID NO: 830276 - protein, 40 aa, Homo sapiens
MPEGHKHLCGGTQRVLGRNNSRGTKAEKRDTPRRTNPRRG

SEQ ID NO: 830277 - protein, 70 aa, Homo sapiens
MVTRAHKGVFPKGNPRAIDHRGLGILPPFIKRARGGNTEGSWTNSQKGVLGGHIRDPFTGECPRELDIIY

SEQ ID NO: 830278 - protein, 110 aa, Homo sapiens
MGRMHAPGKGLSQSALPYRRSVPTWLKLTSDDVKEQIYKLAKKGLTPSQIVLLLSPSLECSGAISAHCNLHLLDSSDSPASASRIGVILRDSHGVAQVRFVTGNKILRNS

SEQ ID NO: 830279 - protein, 82 aa, Homo sapiens
PAEFAAIMGRMHAPGKGLSQSALPYRRSVPTWLKLTSDDVKEQIYKLAKKGLTPSQIGVILRDSHGVAQVRFVTGNKILRNS

SEQ ID NO: 830280 - protein, 95 aa, Homo sapiens
PSRCERRQRGPPFRCLIAAIMGRMHAPGKGLSQSALPYRRSVPTWLKLTSDDVKEQIYKLAKKGLTPSQIGVILRDSHGVAQVRFVTGNKILRNS

SEQ ID NO: 830281 - protein, 88 aa, Homo sapiens
THASGPTRRIAAIMGRMHAPGKGLSQSALPYRRSVPTWLKLTSDDVKEQIYKLAKKGLTPSQIGVILRDSHGVAQVRFVTGNKILRNS

SEQ ID NO: 830282 - protein, 82 aa, Homo sapiens; identical to SEQ ID NO: 830279

SEQ ID NO: 830283 - protein, 95 aa, Homo sapiens; identical to SEQ ID NO: 830280

SEQ ID NO: 830284 - protein, 125 aa, Homo sapiens
MALRACSSHSGKWVSIITWSHQIFPKIQTIQSDSPFLGSSLTLKSVCYFKKSKLGPQEEVLPPRKLSGRPCRLRRSSQVTESAIETGRSPNGPLKPGSPSQSRSQFCEQPETLRRGYGRYLEQAR

SEQ ID NO: 830285 - protein, 97 aa, Homo sapiens; identical to SEQ ID NO: 830271

SEQ ID NO: 830286 - protein, 58 aa, Homo sapiens
MEERTRAEEGRRNENSRKEMRARERGREVGRPEEGEEGEEGEQEKEEGGRRRSEQSGE

SEQ ID NO: 830287 - protein, 79 aa, Homo sapiens
GIRHEGACMAPRKGLSQSALPYRRSVPTWLKLTSDDVKEQIYKLAKKGLTPSQIGVILRDSHGVAQVRFVTGNKILRNS

SEQ ID NO: 830288 - protein, 88 aa, Homo sapiens; identical to SEQ ID NO: 830281

SEQ ID NO: 830289 - protein, 79 aa, Homo sapiens; identical to SEQ ID NO: 830287

SEQ ID NO: 830290 - protein, 699 aa, Homo sapiens
GGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQNKKTLSDPNSHLLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 830291 - protein, 699 aa, Homo sapiens; identical to SEQ ID NO: 830290

SEQ ID NO: 830292 - protein, 699 aa, Homo sapiens; identical to SEQ ID NO: 830290

SEQ ID NO: 830293 - protein, 137 aa, Homo sapiens [sequence omitted]

SEQ ID NO: 830294 - protein, 67 aa, Homo sapiens
HIWSGSQKALHCTFTLERHSLASTELTCKICVRQVEGEGQIFQLHTTLAEVREVGATYSSCTPHWRR

SEQ ID NO: 830295 - protein, 699 aa, Homo sapiens; identical to SEQ ID NO: 830290

SEQ ID NO: 830296 - protein, 699 aa, Homo sapiens; identical to SEQ ID NO: 830290

SEQ ID NO: 830297 - protein, 137 aa, Homo sapiens [sequence omitted]

SEQ ID NO: 830298 - protein, 163 aa, Homo sapiens
GGTSACSWCLSDEARLATCGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 830299 - protein, 66 aa, Homo sapiens
RPPTTTKFAAASTLGRTTCTKTQPNLDNCPFHDQPHLKRKAFCSFQIYAVPWQGTMTLSKSTCQDA

SEQ ID NO: 830300 - protein, 146 aa, Homo sapiens
MAGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 830301 - protein, 146 aa, Homo sapiens; identical to SEQ ID NO: 830300

SEQ ID NO: 830302 - protein, 146 aa, Homo sapiens; identical to SEQ ID NO: 830300

SEQ ID NO: 830303 - protein, 141 aa, Homo sapiens
RPRWGGAAKAGRDKTAVPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 830304 - protein, 135 aa, Homo sapiens
MYSVCVYLMKTWWSLLIYTWESIPLLPPFLGTAAREGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 830305 - protein, 146 aa, Homo sapiens; identical to SEQ ID NO: 830300

SEQ ID NO: 830306 - protein, 146 aa, Homo sapiens; identical to SEQ ID NO: 830300

SEQ ID NO: 830307 - protein, 146 aa, Homo sapiens; identical to SEQ ID NO: 830300

SEQ ID NO: 830308 - protein, 146 aa, Homo sapiens; identical to SEQ ID NO: 830300

SEQ ID NO: 830309 - protein, 146 aa, Homo sapiens; identical to SEQ ID NO: 830300

SEQ ID NO: 830310 - protein, 146 aa, Homo sapiens; identical to SEQ ID NO: 830300

SEQ ID NO: 830311 - protein, 146 aa, Homo sapiens; identical to SEQ ID NO: 830300

SEQ ID NO: 830312 - protein, 127 aa, Homo sapiens
MAGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRSKSTCQDA

SEQ ID NO: 830313 - protein, 92 aa, Homo sapiens
MAGPLRAPLLLLAILAVALAVSPAAGSSPGKPPRLVGGPMDASVEEEVKNVINHLPERLLHFPSVGGDPWFAHWLVGQTPPKQTEGLVVKPH

SEQ ID NO: 830314 - protein, 146 aa, Homo sapiens; identical to SEQ ID NO: 830300

SEQ ID NO: 830315 - protein, 141 aa, Homo sapiens; identical to SEQ ID NO: 830303

SEQ ID NO: 830316 - protein, 146 aa, Homo sapiens; identical to SEQ ID NO: 830300

SEQ ID NO: 830317 - protein, 146 aa, Homo sapiens; identical to SEQ ID NO: 830300

SEQ ID NO: 830318 - protein, 146 aa, Homo sapiens; identical to SEQ ID NO: 830300

SEQ ID NO: 830319 - protein, 174 aa, Homo sapiens
RPRWGGAAKAGRDKTAVAGLAGLTASPRYRSGSSLSSSSLSPAPHSPRPAPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 830320 - protein, 174 aa, Homo sapiens; identical to SEQ ID NO: 830319

SEQ ID NO: 830321 - protein, 146 aa, Homo sapiens; identical to SEQ ID NO: 830300

SEQ ID NO: 830322 - protein, 146 aa, Homo sapiens; identical to SEQ ID NO: 830300

SEQ ID NO: 830323 - protein, 146 aa, Homo sapiens; identical to SEQ ID NO: 830300

SEQ ID NO: 830324 - protein, 75 aa, Homo sapiens
AGRGGVGRRRPEGIKPQSPASRGSRPRLGIAAGPLYLAPASRLRPTPRVPRPSRPWPGPCAPRCSCWPSWPWPWP

SEQ ID NO: 830325 - protein, 146 aa, Homo sapiens; identical to SEQ ID NO: 830300

SEQ ID NO: 830326 - protein, 887 aa, Homo sapiens
GRRRGGALRTQARRSAAPGAAEGAGLAAVVSVAVAVAEFGGWREIQVLTRLVPSATMGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 830327 - protein, 894 aa, Homo sapiens
GRRRGGALRTQARRSAAPGAAEGAGLAAVVSVAVAVAEFGGWREIQVLTRLVPSATMGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEAELHHQQMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 830328 - protein, 887 aa, Homo sapiens; identical to SEQ ID NO: 830326

SEQ ID NO: 830329 - protein, 532 aa, Homo sapiens
MKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 830330 - protein, 101 aa, Homo sapiens
PPRLARQPNCLPHSQTTTLTVPLPHGQTATRTVPLPHSQTTFFTAFATLTVAILLIMEGLSAFLHALRLHWVEFQNKFYSGTGFKFLPFSFEHIREGKFEE

SEQ ID NO: 830331 - protein, 121 aa, Homo sapiens [sequence omitted]

SEQ ID NO: 830332 - protein, 121 aa, Homo sapiens [sequence omitted]

SEQ ID NO: 830333 - protein, 857 aa, Homo sapiens
GRRRGGALRTQARRSAAPGAAEGAGLAAVVSVAVAVAEFGGWREIQVLTRLVPSATMGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHW

SEQ ID NO: 830334 - protein, 734 aa, Homo sapiens
GRRRGGALRTQARRSAAPGAAEGAGLAAVVSVAVAVAEFGGWREIQVLTRLVPSATMGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLVGVFLLLKVT

SEQ ID NO: 830335 - protein, 502 aa, Homo sapiens
GRRRGGALRTQARRSAAPGAAEGAGLAAVVSVAVAVAEFGGWREIQVLTRLVPSATMGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEVMFKLHLH

SEQ ID NO: 830336 - protein, 121 aa, Homo sapiens [sequence omitted]

SEQ ID NO: 830337 - protein, 222 aa, Homo sapiens
GRRRGGALRTQARRSAAPGAAEGAGLAAVVSVAVAVAEFGGWREIQVLTRLVPSATMGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEVRLLFLLVFEQLILYSHKWAIFLFQ

SEQ ID NO: 830338 - protein, 887 aa, Homo sapiens; identical to SEQ ID NO: 830326

SEQ ID NO: 830339 - protein, 887 aa, Homo sapiens; identical to SEQ ID NO: 830326

SEQ ID NO: 830340 - protein, 833 aa, Homo sapiens
GRRRGGALRTQARRSAAPGAAEGAGLAAVVSVAVAVAEFGGWREIQVLTRLVPSATMGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHARLSSRINSTAGPVSSSYPSPSSIFGKGSLKSESL

SEQ ID NO: 830341 - protein, 474 aa, Homo sapiens
GRRRGGALRTQARRSAAPGAAEGAGLAAVVSVAVAVAEFGGWREIQVLTRLVPSATMGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGLRRVQGITLE

SEQ ID NO: 830342 - protein, 689 aa, Homo sapiens
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWKDSKEYGHTFRSDLREEILMLMARDKHPPELQVAFADCAADIKSAYESQPIRQTAQDWPATSLNCIAILFLRAGRTQEAWKMLGLFRKHNKIPRSELLNELMDSAKVSNSPSQAIEVVELASAFSLPICEGLTQRVMSDFAINQEQKEALSNLTALTSDSDTDSSSDSDSDTSEGK

SEQ ID NO: 830343 - protein, 387 aa, Homo sapiens
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIGEDAPLSSLRTETVPARGFRAT

SEQ ID NO: 830344 - protein, 387 aa, Homo sapiens; identical to SEQ ID NO: 830343

SEQ ID NO: 830345 - protein, 276 aa, Homo sapiens
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKLMYTHLMH

SEQ ID NO: 830346 - protein, 607 aa, Homo sapiens
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWKDSKEYGHTFRSDLREEILMLMARDKHPPELQVAFADCAADIKSAYESQPIRQTAQDWPATSLNCIAILFLRAGRTQEAWKMLGLFRKHNKIPR

SEQ ID NO: 830347 - protein, 387 aa, Homo sapiens; identical to SEQ ID NO: 830343

SEQ ID NO: 830348 - protein, 66 aa, Homo sapiens
IGSQAHSAQQVLDNSADLAKRFRKLGAPVVMVRVGWSDTFAEALKQEVDRPSPANLSLVIRISLHT

SEQ ID NO: 830349 - protein, 689 aa, Homo sapiens; identical to SEQ ID NO: 830342

SEQ ID NO: 830350 - protein, 672 aa, Homo sapiens
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWKDSKEYGHTFRSDLREEILMLMARDKHPPELQVAFADCAADIKSAYESQPIRQTAQDWPATSLNCIAILFLRAGRTQEAWKMLGLFRKHNKIPRSELLNELMDSAKVSNSPSQAIEVVELASAFSLPICEGLTQRVMSDFAINQEQKEALSNLTALTSDSDTDSSSDSDSDTSEGK

SEQ ID NO: 830351 - protein, 276 aa, Homo sapiens; identical to SEQ ID NO: 830345

SEQ ID NO: 830352 - protein, 367 aa, Homo sapiens [sequence omitted]

SEQ ID NO: 830353 - protein, 689 aa, Homo sapiens; identical to SEQ ID NO: 830342

SEQ ID NO: 830354 - protein, 594 aa, Homo sapiens
MPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWKDSKEYGHTFRSDLREEILMLMARDKHPPELQVAFADCAADIKSAYESQPIRQTAQDWPATSLNCIAILFLRAGRTQEAWKMLGLFRKHNKIPRSELLNELMDSAKVSNSPSQAIEVVELASAFSLPICEGLTQRVMSDFAINQEQKEALSNLTALTSDSDTDSSSDSDSDTSEGK

SEQ ID NO: 830355 - protein, 595 aa, Homo sapiens
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWKDSKEYGHTFRSDLREEILMLMARDKHPPELQVAFADCAADIKSAYESQPIRQTAQDWPATSLNCIAILFLRAGRTQEACWK

SEQ ID NO: 830356 - protein, 279 aa, Homo sapiens
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKPEPTVLSLLWG

SEQ ID NO: 830357 - protein, 111 aa, Homo sapiens
HHYQPKKWPDERKIDGQERMLGFSFLLLAQDLLELKHKAGDTSQSSSEELTGIIKIEPTTYPGANSIAPSIIIVSSHVLSPSMNLNNVNVISDRKDHLLSLPVFPAYLLRR

SEQ ID NO: 830358 - protein, 519 aa, Homo sapiens
GGGGGGTWGGERFARFGPSPDSPPPPPYSRGIFLTLSILRTRDLPSGAMSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRECVRVPRGGIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830359 - protein, 371 aa, Homo sapiens
MSFALSIFTKSGREFLFSSLGCLQISFIFNFSFLRYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830360 - protein, 532 aa, Homo sapiens
GGGGGGTWGGERFARFGPSPDSPPPPPYSRGIFLTLSILRTRDLPSGAMSEGVDLIDIYADEEFNQDPEFNNTDQIDLYDDVLTATSQPSDDRSSSTEPPPPVRQEPSPKPNNKTPAILYTYSGLRNRRAAVYVGSFSWVGLISERELPEDVLVPKKAMIEWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830361 - protein, 337 aa, Homo sapiens
GGGGGGTWGGERFARFGPSPDSPPPPPYSRGIFLTLSILRTRDLPSGAMSEGVDLIDIYADEEFNQDPEFNNTDQIDLYDDVLTATSQPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830362 - protein, 250 aa, Homo sapiens
KKGTGSMRDTGIENGTGTTEKGVWLEANVFNGLASPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830363 - protein, 510 aa, Homo sapiens
GGGGGGTWGGERFARFGPSPDSPPPPPYSRGIFLTLSILRTRDLPSGAMSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830364 - protein, 510 aa, Homo sapiens; identical to SEQ ID NO: 830363

SEQ ID NO: 830365 - protein, 510 aa, Homo sapiens; identical to SEQ ID NO: 830363

SEQ ID NO: 830366 - protein, 510 aa, Homo sapiens; identical to SEQ ID NO: 830363

SEQ ID NO: 830367 - protein, 418 aa, Homo sapiens
GGGGGGTWGGERFARFGPSPDSPPPPPYSRGIFLTLSILRTRDLPSGAMSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGNSVLTFAAFSLTFTFFS

SEQ ID NO: 830368 - protein, 373 aa, Homo sapiens
GGGGGGTWGGERFARFGPSPDSPPPPPYSRGIFLTLSILRTRDLPSGAMSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRECVRVPRGGIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASGRAAVNLVVVG

SEQ ID NO: 830369 - protein, 510 aa, Homo sapiens; identical to SEQ ID NO: 830363

SEQ ID NO: 830370 - protein, 497 aa, Homo sapiens
GGRARRAGGIFLTLSILRTRDLPSGAMSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRECVRVPRGGIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830371 - protein, 394 aa, Homo sapiens
MTEAAALNHLLLFARSHLPSPTTRPLQFCIPTVACVIDELPFMWAASPGYAEVVVASENSVHKLLELLPGKVLNGEKVDVRPATRQNLSQFEAQARKRECVRVPRGGIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830372 - protein, 443 aa, Homo sapiens
GGGGGGTWGGERFARFGPSPDSPPPPPYSRGIFLTLSILRTRDLPSGAMSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830373 - protein, 156 aa, Homo sapiens
MVFSLYSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 830374 - protein, 510 aa, Homo sapiens; identical to SEQ ID NO: 830363

SEQ ID NO: 830375 - protein, 111 aa, Homo sapiens; identical to SEQ ID NO: 830357

SEQ ID NO: 830376 - protein, 418 aa, Homo sapiens; identical to SEQ ID NO: 830367

SEQ ID NO: 830377 - protein, 113 aa, Homo sapiens
GGGGGGTWGGERFARFGPSPDSPPPPPYSRGIFLTLSILRTRDLPSGAMSEGVDLIDIYADEEFNQDPEFNNTDQIDLYDDVLTATSQPSDDRSSSTEPPRRIPDDHDEFRHD

SEQ ID NO: 830378 - protein, 838 aa, Homo sapiens
GTRRARSQRAAGADGRRGGRRQGRSVYSCSGAVSWRRLGRLLSPGSAAAAKAAAPALSLSLSRLWLQVKGKQARMDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQR

SEQ ID NO: 830379 - protein, 304 aa, Homo sapiens
ILLLLFRRTWTVETFLRMVQCRSWRAAVASRCPSSILGPSPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKGEGAQNQGKKAEGAQNQGKKAEGAQNQGKKAEGAQNQGKKAEGAQNQGKKAEG

SEQ ID NO: 830380 - protein, 764 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQR

SEQ ID NO: 830381 - protein, 770 aa, Homo sapiens
MLSWLLSTPGLGCSYLNSRGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQR

SEQ ID NO: 830382 - protein, 785 aa, Homo sapiens
MLSWLLSTPGLGCSYLNSRGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVCALLRELFLLSREPL

SEQ ID NO: 830383 - protein, 785 aa, Homo sapiens; identical to SEQ ID NO: 830382

SEQ ID NO: 830384 - protein, 770 aa, Homo sapiens; identical to SEQ ID NO: 830381

SEQ ID NO: 830385 - protein, 770 aa, Homo sapiens; identical to SEQ ID NO: 830381

SEQ ID NO: 830386 - protein, 770 aa, Homo sapiens; identical to SEQ ID NO: 830381

SEQ ID NO: 830387 - protein, 343 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEIPGHSEASRRDCREAKRRT

SEQ ID NO: 830388 - protein, 435 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEKVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILGG

SEQ ID NO: 830389 - protein, 129 aa, Homo sapiens
MPYTFLTNKPTNLHSVIQAQLPVAPREAMRDKSLRATEVDLPEPQFVNEPVSHLINTILGAAPGHRRVTPKPWLTLTAPWVCGRPGALGSVCQCNRLVFFQWGGAGSGWDRAASSQRLWGRLEATAPHP

SEQ ID NO: 830390 - protein, 770 aa, Homo sapiens; identical to SEQ ID NO: 830381

SEQ ID NO: 830391 - protein, 785 aa, Homo sapiens; identical to SEQ ID NO: 830382

SEQ ID NO: 830392 - protein, 129 aa, Homo sapiens; identical to SEQ ID NO: 830389

SEQ ID NO: 830393 - protein, 374 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKGEGAQNQGKKAEGAQNQGKKAEGAQNQGKKAEGAQNQGKKAEGAQNQGKKAEG

SEQ ID NO: 830394 - protein, 200 aa, Homo sapiens
MLSWLLSTPGLGCSYLNSRGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEQGKKGEGAQNQGKKAEGAQNQGKKAVGPTGGHSPSPLDVANQN

SEQ ID NO: 830395 - protein, 164 aa, Homo sapiens
PSKEEASPKVPGLGGSSSHYLYILCHAKEKKHAPITLRRSRRSLTILKLSQSGCDPHPCAGSFVNFGHSFFTFLKAPEPTNKWPGPLLNQIVSCKATCPPSFNLTCHVGFGLIPPPIQGGMEMSGLMCQVITARERVGPGSQFSKAVGPTGGHSPSPLDVANQN

SEQ ID NO: 830396 - protein, 770 aa, Homo sapiens; identical to SEQ ID NO: 830381

SEQ ID NO: 830397 - protein, 764 aa, Homo sapiens; identical to SEQ ID NO: 830380

SEQ ID NO: 830398 - protein, 495 aa, Homo sapiens
GNTADVADIYIRVDLYERVDEASITQAITPARRGSRDDPSTLVALLMQDITGEHVRHASPWYREASLRDRYSMCMAELHILHEQLCEWTASLAWRLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQR

SEQ ID NO: 830399 - protein, 770 aa, Homo sapiens; identical to SEQ ID NO: 830381

SEQ ID NO: 830400 - protein, 200 aa, Homo sapiens
LEFDGFSLAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQR

SEQ ID NO: 830401 - protein, 770 aa, Homo sapiens; identical to SEQ ID NO: 830381

SEQ ID NO: 830402 - protein, 129 aa, Homo sapiens; identical to SEQ ID NO: 830389

SEQ ID NO: 830403 - protein, 770 aa, Homo sapiens; identical to SEQ ID NO: 830381

SEQ ID NO: 830404 - protein, 770 aa, Homo sapiens; identical to SEQ ID NO: 830381

SEQ ID NO: 830405 - protein, 129 aa, Homo sapiens; identical to SEQ ID NO: 830389

SEQ ID NO: 830406 - protein, 186 aa, Homo sapiens
MLSWLLSTPGLGCSYLNSRGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGVKTVRPRPRGQRVSQQPCYATSPPGVLKTNLLPFLTLIPTTDPWIAGNGSQVGSWHKFCNLQNKTFFL

SEQ ID NO: 830407 - protein, 37 aa, Homo sapiens
MVGVRLAVHLQTHPFLFQVRQQLSEMKSHVEDGDIAG

SEQ ID NO: 830408 - protein, 152 aa, Homo sapiens
MPPKFKRHLNDDDVTGSVKSERRNLLEDDSDEEEDFFLRGPSGPRFGPRNDKIKHVQNQVDEVIDVMQENITKVIERGERLDELQDKSESLSDNATAFSNRSKQLRRQMWWRGCKNKSPSWALGCLLIPFCLVDLFNFFISPWKNNPAPLEI

SEQ ID NO: 830409 - protein, 80 aa, Homo sapiens
PPSADRLDERRRCCGAAADAGSAPTVSPSQLLTSASYSFPRPPSTASPGELPGVPREPQVVTILLRSKRYFASKKYASQV

SEQ ID NO: 830410 - protein, 80 aa, Homo sapiens; identical to SEQ ID NO: 830409

SEQ ID NO: 830411 - protein, 101 aa, Homo sapiens
MPPKFKRHLNDDDVTGSVKSERRNLLEDDSDEEEDFFLRGPSGPRFGPRNDKIKHVQNQVRQGQWGGEIQRTAVCSTYQDFICIIESTLQGSWKFTYIRLD

SEQ ID NO: 830412 - protein, 141 aa, Homo sapiens
MPPKFKRHLNDDDVTGSVKSERRNLLEDDSDEEEDFFLRGPSGPRFGPRNDKIKHVQNQVDEVIDVMQENITKVIERGERLDELQDKSESLSDNATAFSNRSKQLRRQMWWRGCKIKAIMALVAAILLLVIIILIVMKYRT

SEQ ID NO: 830413 - protein, 141 aa, Homo sapiens; identical to SEQ ID NO: 830412

SEQ ID NO: 830414 - protein, 80 aa, Homo sapiens; identical to SEQ ID NO: 830409

SEQ ID NO: 830415 - protein, 80 aa, Homo sapiens; identical to SEQ ID NO: 830409

SEQ ID NO: 830416 - protein, 577 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDAMILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGIAMD

SEQ ID NO: 830417 - protein, 295 aa, Homo sapiens
YSQRDVPLAIGGVQMHHSDFTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGIAMD

SEQ ID NO: 830418 - protein, 600 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFDIKGTISHIELAVISLCSWHYRNASSSTRGRSQTRESEIRVRLQSASPSTRWTELDDVKRLLKGSRSASVSPTRNSSNTLPIPKKGTVETKIVTASSQSVSGTYDAMILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGIAMD

SEQ ID NO: 830419 - protein, 327 aa, Homo sapiens
MQKIKSLMTRQGLKSPQESLSDLGAIESLRVPGKEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTVCSDLITIHISLL

SEQ ID NO: 830420 - protein, 95 aa, Homo sapiens
TVEAFGSNSPSGIKTKEDLNEEQEDLSELNSKLQDTLEQIEEQLDVALSKICKNFDINHYTKCKHIWVCDMHRDFGQYEDPRPEDTCTTVEKDPV

SEQ ID NO: 830421 - protein, 775 aa, Homo sapiens
MLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVGKYMQMMNILKPIAFDVIHFMSQLFDYYLYAIYTFFGRNDSLESTGLGLSSSRLRTTLNRIQESLIDLEVSADPTATLTAAEERKEKVPSPHLSHLVVLTSGDTLYGLAERVVATESLVFLAEQFEFLQPHLDAVMPAVKKPFLQQFYSQTVSTASELRKPIYWIVAGKALDYEQMLLLMANVKWDVKEIMSQHNIYVDALLKEFEQFNRRLNEVSKRVRIPLPVSNILWEHCIRLANRTIVEGYANVKKCSNEGRALMQLDFQQFLMKLEKLTDIRPIPDKEFVETYIKAYYLTENDMERWIKEHREYSTKQLTNLVNVCLGSHINKKARQKLLAAIDDIDRPKR

SEQ ID NO: 830422 - protein, 682 aa, Homo sapiens
MQKIKSLMTRQGLKSPQESLSDLGAIESLRVPGKEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVDGVSLCCLGWSTVAHLHSLQAPPPGFKPFSCLSLPRSWDYRRPPPRPANFLYFLLFSRDGVSPC

SEQ ID NO: 830423 - protein, 78 aa, Homo sapiens
QAGTTLRVAIADPRCRYETYIKAYYLTENDMERWIKEHREYSTKQLTNLVNVCLGSHINKKARQKLLAAIDDIDRPKR

SEQ ID NO: 830424 - protein, 70 aa, Homo sapiens
RTSFLKKCSTPFQHTFESQQSGTRCTQSPVGLKIFAMLKLSARKAVAGSGAESSVRAAAGQEPLATPSGS

SEQ ID NO: 830425 - protein, 867 aa, Homo sapiens
MLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVGKYMQMMNILKPIAFDVIHFMSQLFDYYLYAIYTFFGRNDSLESTGLGLSSSRLRTTLNRIQESLIDLDMFDMKSKNVHKLISKAFVAWHQNTKKGKLVMRRFLMSISSDESKTEKFEVQMSFPDHKLDCITPVDYMAVYTESVVLSWMVLKSLAHPASWEVSADPTATLTAAEERKEKVPSPHLSHLVVLTSGDTLYGLAERVVATESLVFLAEQFEFLQPHLDAVMPAVKKPFLQQFYSQTVSTASELRKPIYWIVAGKALDYEQMLLLMANVKWDVKEIMSQHNIYVDALLKEFEQFNRRLNEVSKRVRIPLPVSNILWEHCIRLANRTIVEGYANVKKCSNEGRALMQLDFQQFLMKLEKLTDIRPIPDKEFVETYIKAYYLTENDMERWIKEHREYSTKQLTNLVNVCLGSHINKKARQKLLAAIDDIDRPKR

SEQ ID NO: 830426 - protein, 964 aa, Homo sapiens
MQKIKSLMTRQGLKSPQESLSDLGAIESLRVPGKEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVGKYMQMMNILKPIAFDVIHFMSQLFDYYLYAIYTFFGRNDSLESTGLGLSSSRLRTTLNRIQESLIDLEVSADPTATLTAAEERKEKVPSPHLSHLVVLTSGDTLYGLAERVVATESLVFLAEQFEFLQPHLDAVMPAVKKPFLQQFYSQTVSTASELRKPIYWIVAGKALDYEQMLLLMANVKWDVKEIMSQHNIYVDALLKEFEQFNRRLNEVSKRVRIPLPVSNILWEHCIRLANRTIVEGYANVKKCSNEGRALMQLDFQQFLMKLEKLTDIRPIPDKEFVETYIKAYYLTENDMERWIKEHREYSTKQLTNLVNVCLGSHINKKARQKLLAAIDDIDRPKR

SEQ ID NO: 830427 - protein, 775 aa, Homo sapiens; identical to SEQ ID NO: 830421

SEQ ID NO: 830428 - protein, 682 aa, Homo sapiens; identical to SEQ ID NO: 830422

SEQ ID NO: 830429 - protein, 181 aa, Homo sapiens; identical to SEQ ID NO: 780359

SEQ ID NO: 830430 - protein, 181 aa, Homo sapiens; identical to SEQ ID NO: 780359

SEQ ID NO: 830431 - protein, 181 aa, Homo sapiens; identical to SEQ ID NO: 780359

SEQ ID NO: 830432 - protein, 181 aa, Homo sapiens; identical to SEQ ID NO: 780359

SEQ ID NO: 830433 - protein, 181 aa, Homo sapiens; identical to SEQ ID NO: 780359

SEQ ID NO: 830434 - protein, 284 aa, Homo sapiens
VPVAASGATVEWNVTGCVTPEEWVPWACMPVCLNVCRLVDASRDAGAGYSAVVQDVLCCDCMLCCSLIAVNSDQVFHTRDQAKTRLPLPLLGPHCPQKAAAVIMGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 830435 - protein, 266 aa, Homo sapiens
MYHIFTCVLFPSIELLPCIVRIFIVVYLAFPKRLDAFRLQELDFVSSSTMPMQTDQVFHTRDQAKTRLPLPLLGPHCPQKAAAVIMGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 830436 - protein, 217 aa, Homo sapiens
MPMQTDQVFHTRDQAKTRLPLPLLGPHCPQKAAAVIMGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 830437 - protein, 221 aa, Homo sapiens
SASSSRFKSDQVFHTRDQAKTRLPLPLLGPHCPQKAAAVIMGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 830438 - protein, 169 aa, Homo sapiens
MDPLSQFGTLVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 830439 - protein, 181 aa, Homo sapiens; identical to SEQ ID NO: 780359

SEQ ID NO: 830440 - protein, 176 aa, Homo sapiens
MDNSELIRNVTLGGHLHHGKVRENFQLLGTGFLFCTCSCLSPESRFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 830441 - protein, 181 aa, Homo sapiens; identical to SEQ ID NO: 780359

SEQ ID NO: 830442 - protein, 181 aa, Homo sapiens; identical to SEQ ID NO: 780359

SEQ ID NO: 830443 - protein, 181 aa, Homo sapiens; identical to SEQ ID NO: 780359

SEQ ID NO: 830444 - protein, 181 aa, Homo sapiens; identical to SEQ ID NO: 780359

SEQ ID NO: 830445 - protein, 150 aa, Homo sapiens
MSHSNLLDLKQKVVTVSWGGPSLSLTSGFREVEWGILFVWQWLLSSWHLSPFPVPTSPSTPCLPFLCHPLPVLHGNCTGLSVFACMCAPVYTCIERYICGGRGERGGGGVKLRACSQDTAHWSLSSAPSVLVRLREEGGRALVKPDCPSL

SEQ ID NO: 830446 - protein, 181 aa, Homo sapiens; identical to SEQ ID NO: 780359

SEQ ID NO: 830447 - protein, 181 aa, Homo sapiens; identical to SEQ ID NO: 780359

SEQ ID NO: 830448 - protein, 181 aa, Homo sapiens; identical to SEQ ID NO: 780359

SEQ ID NO: 830449 - protein, 181 aa, Homo sapiens; identical to SEQ ID NO: 780359

SEQ ID NO: 830450 - protein, 181 aa, Homo sapiens; identical to SEQ ID NO: 780359

SEQ ID NO: 830451 - protein, 181 aa, Homo sapiens; identical to SEQ ID NO: 780359

SEQ ID NO: 830452 - protein, 181 aa, Homo sapiens; identical to SEQ ID NO: 780359

SEQ ID NO: 830453 - protein, 266 aa, Homo sapiens; identical to SEQ ID NO: 830435

SEQ ID NO: 830454 - protein, 181 aa, Homo sapiens; identical to SEQ ID NO: 780359

SEQ ID NO: 830455 - protein, 164 aa, Homo sapiens
MTRDSLGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 830456 - protein, 139 aa, Homo sapiens
LPVFFPKGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 830457 - protein, 165 aa, Homo sapiens
VQILVVGGGHLLGRLAAIVAKQVLLGRKVVVVRCEGINISGNFYRNKLKYLAFLRKPVQIWVLGGGKEGGSRGVGQAANDRERVNEAREELMRMLAEDELRDAVLLVFANKQDLPNAMNAAEITDKLGLHSLRHRNWYIQATCATSGDGLYEGLDWLANQLKNKK

SEQ ID NO: 830458 - protein, 181 aa, Homo sapiens; identical to SEQ ID NO: 780359

SEQ ID NO: 830459 - protein, 262 aa, Homo sapiens
VQILVVGGGHLLGRLAAIVAKQVLLGRKVVVVRCEGINISGNFYRNKLKYLAFLRKPVQIWVLGGGKEGGSRGVGQAALGIMSTCPARALPPLPPLLFPVHLYDQSLIAVLMMSHSNLLDLKQKVVTVSWGGPSLSLTSGFREVEWGILFVWQWLLSSWHLSPFPVPTSPSTPCLPFLCHPLPVLHGNCTGLSVFACMCAPVYTCIERYICGGRGERGGGGVKLRACSQDTAHWSLSSAPSVLVRLREEGGRALVKPDCPSL

SEQ ID NO: 830460 - protein, 167 aa, Homo sapiens
MGNIFGNLLKSLIGKKEMRILMVGLDAAGKTTILYKLKLGEIVTTIPTIVVAVLLASESFPCPHKPFYSLFAFPLPPSPCFTWKLHGPLCVCVHVCACIYMYREIYLWGPGGAGRGWSEAQGLQPGHCPLEPVICPFRVGEIKGRRWEGISQAGLPQSLTGYPPLCR

SEQ ID NO: 830461 - protein, 181 aa, Homo sapiens; identical to SEQ ID NO: 780359

SEQ ID NO: 830462 - protein, 86 aa, Homo sapiens
DIQELMVTSEELTEDNLMKKSASKPGQTVRKQHAEAVPENKSTLDNLAEGLQLSKSAFDLFLGHKPCYDTGTKIKANGGRRIGAMV

SEQ ID NO: 830463 - protein, 320 aa, Homo sapiens
MSVGFIGAGQLAYALARGFTAAGILSAHKIIASSPEMNLPTVSALRKMGVNLTRSNKETVKHSDVLFLAVKPHIIPFILDEIGADVQARHIVVSCAAGVTISSVEKKLMAFQPAPKVIRCMTNTPVVVQEGATVYATGTHALVEDGQLLEQLMSSVGFCTEVEEDLIDAVTGLSGSGPAYAFMALDALADGGVKMGLPRRLAIQLGAQALLGAAKMLLDSEQHPCQLKDNVCSPGGATIHALHFLESGGFRSLLINAVEASCIRTRELQSMADQEKISPAALKKTLLDRVKLESPTVSTLTPSSPGKLLTRSLALGGKKD

SEQ ID NO: 830464 - protein, 320 aa, Homo sapiens; identical to SEQ ID NO: 830463

SEQ ID NO: 830465 - protein, 320 aa, Homo sapiens; identical to SEQ ID NO: 830463

SEQ ID NO: 830466 - protein, 273 aa, Homo sapiens [sequence omitted]

SEQ ID NO: 830467 - protein, 284 aa, Homo sapiens
MNLPTVSALRKMGVNLTRSNKETVKHSDVLFLAVKPHIIPFILDEIGADVQARHIVVSCAAGVTISSVEKKLMAFQPAPKVIRCMTNTPVVVQEGATVYATGTHALVEDGQLLEQLMSSVGFCTEVEEDLIDAVTGLSGSGPAYAFMALDALADGGVKMGLPRRLAIQLGAQALLGAAKMLLDSEQHPCQLKDNVCSPGGATIHALHFLESGGFRSLLINAVEASCIRTRELQSMADQEKISPAALKKTLLDRVKLESPTVSTLTPSSPGKLLTRSLALGGKKD

SEQ ID NO: 830468 - protein, 284 aa, Homo sapiens
MLWRGASRPQKMGVNLTRSNKETVKHSDVLFLAVKPHIIPFILDEIGADVQARHIVVSCAAGVTISSVEKKLMAFQPAPKVIRCMTNTPVVVQEGATVYATGTHALVEDGQLLEQLMSSVGFCTEVEEDLIDAVTGLSGSGPAYAFMALDALADGGVKMGLPRRLAIQLGAQALLGAAKMLLDSEQHPCQLKDNVCSPGGATIHALHFLESGGFRSLLINAVEASCIRTRELQSMADQEKISPAALKKTLLDRVKLESPTVSTLTPSSPGKLLTRSLALGGKKD

SEQ ID NO: 830469 - protein, 175 aa, Homo sapiens
MSVGFIGAGQLAYALARGFTAAGILSAHKIIASSPEMNLPTVSALRKMGVNLTRSNKETVKHSDVLFLAVKPHIIPFILDEIGADVQARHIVVSCAAGVTISSVEKKLMAFQPAPKVIRCMTNTPVVVQEGATVYATGTHALVEDGQLLEQLMSSVGFCTEVEEDLQLKPEAGLV

SEQ ID NO: 830470 - protein, 315 aa, Homo sapiens
MGVNLTRSNKETVKHSDVLFLAVKPHIIPFILDEIGADVQARHIVVSCAAGVTISSVEKVPISALMPLVLRGGLTHEWQLMGGCWWEPCPGHSFGSLPHPEKLMAFQPAPKVIRCMTNTPVVVQEGATVYATGTHALVEDGQLLEQLMSSVGFCTEVEEDLIDAVTGLSGSGPAYAFMALDALADGGVKMGLPRRLAIQLGAQALLGAAKMLLDSEQHPCQLKDNVCSPGGATIHALHFLESGGFRSLLINAVEASCIRTRELQSMADQEKISPAALKKTLLDRVKLESPTVSTLTPSSPGKLLTRSLALGGKKD

SEQ ID NO: 830471 - protein, 320 aa, Homo sapiens; identical to SEQ ID NO: 830463

SEQ ID NO: 830472 - protein, 273 aa, Homo sapiens [sequence omitted]

SEQ ID NO: 830473 - protein, 284 aa, Homo sapiens; identical to SEQ ID NO: 830467

SEQ ID NO: 830474 - protein, 289 aa, Homo sapiens
MSVGFIGAGQLAYALARGFTAAGILSAHKIIASSPEMNLPTVSALRKMGVNLTRSNKETVKHSDVLFLAVKPHIIPFILDEIGADVQARHIVVSCAAGVTISSVEKKLMAFQPAPKVIRCMTNTPVVVQEGATVYATGTHALVEDGQLLEQLMSSVGFCTEVEEDLIDAVTGLSGSGPAYGAAKMLLDSEQHPCQLKDNVCSPGGATIHALHFLESGGFRSLLINAVEASCIRTRELQSMADQEKISPAALKKTLLDRVKLESPTVSTLTPSSPGKLLTRSLALGGKKD

SEQ ID NO: 830475 - protein, 142 aa, Homo sapiens
MSVGFIGAGQLAYALARGFTAAGILSAHKIIASSPEMNLPTVSALRKMGVNLTRSNKETVKHSDVLFLAVKPHIIPFILDEIGADVQARHIVVSCAAGVTISSVEKKLMAFQPAPKVIRCMTNTNPHGWRLKVWPQGGQKGG

SEQ ID NO: 830476 - protein, 66 aa, Homo sapiens
IRGTRQSNEETGGCVGHLWGQEQRFNDEEEIEDGARRIPQASDTELCIDHVTSSYPEQLLSRMPYH

SEQ ID NO: 830477 - protein, 56 aa, Homo sapiens
MKLLKSFGEDEIEMKVVSLLDSTSSMVSAFTFLSSPQWSGVNGERGLLLKSDWTVN

SEQ ID NO: 830478 - protein, 688 aa, Homo sapiens
MTDALLPAAPQPLEKENDGYFRKGCNPLAQTGRSKLQNQRAALNQQILKAVRMRTGAENLLKVATNSKVREQVRLELSFVNSDLQMLKEELEGLNISVGVYQNTEEAFTIPLIPLGLKETKDVDFAVVLKDFILEHYSEDGYLYEDEIADLMDLRQACRTPSRDEAGVELLMTYFIQLGFVESRFFPPTRQMGLLFTWYDSLTGVPVSQQNLLLEKASVLFNTGALYTQIGTRCDRQTQAGLESAIDAFQRAAGVLNYLKDTFTHTPSYDMSPAMLSVLVKMMLAQAQESVFEKISLPGIRNEFFMLVKVAQEAAKVGEVYQQLHAAMSQAPVKENIPYSWASLACVKAHHYAALAHYFTAILLIDHQVKPGTDLDHQEKCLSQLYDHMPEGLTPLATLKNDQQRRQLGKSHLRRAMAHHEESVREASLCKKLRSIEVLQKVLCAAQERSRLTYAQHQEEDDLLNLIDAPSVVAKTEQEVDIILPQFSKLTVTDFFQKLGPLSVFSANKRWTPPRSIRFTAEEGDLGFTLRGNAPVQVHFLDPYCSASVAGAREGDYIVSIQLVDCKWLTLSEVMKLLKSFGEDEIEMKVVSLLDSTSSMHNKSATYSVGMQKTYSMICLAIDDDDKTDKTKKISKKLSFLSWGTNKEQTEVSQHLVPPIGRGCTASGQEEAALPFQPSQLRQFLVLM

SEQ ID NO: 830479 - protein, 114 aa, Homo sapiens
MKLLKSFGEDEIEMKVVSLLDSTSSMHNKSATYSVGMQKTYSMICLAIDDDDKTDKTKKISKKLSFLSWGTNKEQTEVSQHLVPPIGRGCTASGQEEAALPFQPSQLRQFLVLM

SEQ ID NO: 830480 - protein, 152 aa, Homo sapiens
MTDALLPAAPQPLEKENDGYFRKGCNPLAQTGRSKLQNQRAALNQQILKAVRMRTGAENLLKVATNSKVREQVRLELSFVNSDLQMLKEELEGLNISVGVYQNTEEAFTIPLIPLGLKETKDVDFAVVLKVGLKVIAVFPLKVMAKVLGLQA

SEQ ID NO: 830481 - protein, 688 aa, Homo sapiens; identical to SEQ ID NO: 830478

SEQ ID NO: 830482 - protein, 114 aa, Homo sapiens; identical to SEQ ID NO: 830479

SEQ ID NO: 830483 - protein, 276 aa, Homo sapiens
MTDALLPAAPQPLEKENDGYFRKGCNPLAQTGRSKLQNQRAALNQQILKAVRMRTGAENLLKVATNSKVREQVRLELSFVNSDLQMLKEELEGLNISVGVYQNTEEAFTIPLIPLGLKETKDVDFAVVLKDFILEHYSEDGYLYEDEIADLMDLRQACRTPSRDEAGVELLMTYFIQLGFVESRFFPPTRQMGLLFTWYDSLTGVPVSQQNLLLEKASVLFNTGALYTQIGTRCDRQTQAGLESAIDAFQRAAGMSPPGLTRRSLGPTRWHQGTPH

SEQ ID NO: 830484 - protein, 115 aa, Homo sapiens
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLLSSECRTTDGFGCA

SEQ ID NO: 830485 - protein, 457 aa, Homo sapiens
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSENLAHHLEIDSDRQPEPGSLGRQEVSEVHPAEEDLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 830486 - protein, 585 aa, Homo sapiens
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSGKGEGATVFPSPISCPPVFHPSPSFSALEDLARDIFPPQSLPLVISIYSGALFPEHLLHSLRTGAGLRVQEGEDPSPPLDHSRSRVFCPHLHIVLKSPCPWGCLEEVISHRSLFLFLLPSENLAHHLEIDSGVITLDPQTASRSLVLSEDRKSVRYTRQKKSLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 830487 - protein, 324 aa, Homo sapiens [sequence omitted]

SEQ ID NO: 830488 - protein, 465 aa, Homo sapiens [sequence omitted]

SEQ ID NO: 830489 - protein, 465 aa, Homo sapiens [sequence omitted]

SEQ ID NO: 830490 - protein, 332 aa, Homo sapiens
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSENLAHHLEIDSGVITLDPQTASRSLVLSEDRNLRVQNHRRLRLCLGQQPT

SEQ ID NO: 830491 - protein, 170 aa, Homo sapiens
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCVFCREGPTHQAHTVGFLDEAIQPYRDRLRSRLEALSTERDEIEDVKCQEDQKLQVLLQCAARGLPVPA

SEQ ID NO: 830492 - protein, 122 aa, Homo sapiens
MFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 830493 - protein, 122 aa, Homo sapiens; identical to SEQ ID NO: 830492

SEQ ID NO: 830494 - protein, 70 aa, Homo sapiens
SLLTPSGFRSGRSVPTMGLELYLDLLSQPCRAVYIFAKKNDIPFELRIVDLIKGRSSLGFGEPKSQEGDR

SEQ ID NO: 830495 - protein, 256 aa, Homo sapiens
SLLTPSGFRSGRSVPTMGLELYLDLLSQPCRAVYIFAKKNDIPFELRIVDLIKGQHLSDAFAQVNPLKKVPALKDGDFTLTESVAILLYLTRKYKVPDYWYPQDLQARARVDEYLAWQHTTLRRSCLRALWHKVMFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 830496 - protein, 122 aa, Homo sapiens; identical to SEQ ID NO: 830492

SEQ ID NO: 830497 - protein, 242 aa, Homo sapiens
SLLTPSGFRSGRSVPTMGLELYLDLLSQPCRAVYIFAKKNDIPFELRIVDLIKDGVSLCRPGWSAVAGSQLTATSAARNLVLCLLFLLGRSALKRCLCPGEPPQEGASLEGRGLHLDGEVMFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 830498 - protein, 121 aa, Homo sapiens
SLLTPSGFRSGRSVPTMGLELYLDLLSQPCRAVYIFAKKNDIPFELRIVDLIKGQHLSDAFAQVNPLKKVPALKDGDFTLTESPWVLAAKSSKADPSWPHGGSAWRQQWGRTSSRRPMRSF

SEQ ID NO: 830499 - protein, 198 aa, Homo sapiens
SLLTPSGFRSGRSVPTMGLELYLDLLSQPCRAVYIFAKKNDIPFELRIVDLIKGQHLSDAFAQVNPLKKVPALKDGDFTLTESVAILLYLTRKYKVPDYWYPQDLQARARVDEYLAWQHTTLRRSCLRALWHKVMFPVFLGEPVSPQTLAATLAELDVTLQLLEDKFLQNKAFLTGPHISLADLVAITELMHVSAVGR

SEQ ID NO: 830500 - protein, 256 aa, Homo sapiens; identical to SEQ ID NO: 830495

SEQ ID NO: 830501 - protein, 122 aa, Homo sapiens; identical to SEQ ID NO: 830492

SEQ ID NO: 830502 - protein, 83 aa, Homo sapiens
SLLTPSGFRSGRSVPTMGLELYLDLLSQPCRAVYIFAKKNDIPFELRIVDLIKGQHLSDAFAQVNPLKKVPALKDGDFTLTER

SEQ ID NO: 830503 - protein, 122 aa, Homo sapiens; identical to SEQ ID NO: 830492

SEQ ID NO: 830504 - protein, 182 aa, Homo sapiens
WTAVSSVHAPVPIVGDLDLTDRKPEGYPQDLQARARVDEYLAWQHTTLRRSCLRALWHKVMFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 830505 - protein, 122 aa, Homo sapiens; identical to SEQ ID NO: 830492

SEQ ID NO: 830506 - protein, 359 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLV

SEQ ID NO: 830507 - protein, 157 aa, Homo sapiens
MVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLV

SEQ ID NO: 830508 - protein, 157 aa, Homo sapiens; identical to SEQ ID NO: 830507

SEQ ID NO: 830509 - protein, 121 aa, Homo sapiens
MDRLCCLRPPPHRDPARLLLASTDDKRNSPKIRPLQPAVPACLPATVRPALASSSAGLSAGFWGQKSGEPRGRVRGDQVRAATFLVISPMGRRGWRDTPPRLPHTTSVSPGSVLFLCQVST

SEQ ID NO: 830510 - protein, 231 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRWAWLCAPVVPATQEAEAGGSLKPRRLRLK

SEQ ID NO: 830511 - protein, 134 aa, Homo sapiens
EAWAVTVVPWGYSGIGTAAHLGREGSCGPSGMQWAGGRAGWAVGLTRSSPGSDKGAHESLALGRLGHSLTLCPPPGPQRDAQAAREFILKMFVDLNPDSDKIIYSHFTCATDTENIRFVFAAVKDTILQLNLKE

SEQ ID NO: 830512 - protein, 387 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLLSGDVHLSLRTLRAPSHLLSTAKAAFFWP

SEQ ID NO: 830513 - protein, 141 aa, Homo sapiens
MVDVGGQRSERRKWIHCFENVTSIMFLVALSEYDQVLVESDNEPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLV

SEQ ID NO: 830514 - protein, 85 aa, Homo sapiens
LGSEAGFALLSHPEASFFCARCLPKRVGARSPPWRVLGPGGALGEQMGPPLAGPLQLFPAAEPSGGPVLVASLRAQIAQGDLAVA

SEQ ID NO: 830515 - protein, 199 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATMDTTPSNRDGTAEEGGPRTGSRPACHTPHP

SEQ ID NO: 830516 - protein, 54 aa, Homo sapiens
VGFSFFRLSSPQASTLLDDMVLPRRWGCWGLTEETGVAGRFGYSSAVPTFGLCL

SEQ ID NO: 830517 - protein, 249 aa, Homo sapiens
DRLSLLSPRLECNGMILAHCKLRLPGFKRFSCLSLPSSWDYRHVPPRQVHFVFSVETGFHRAGQAGLELLTSSVPPTSAFPKCWDYRRDDQAWPTLSSFRGLNKFAFLPKFFAHPISQFQRVECNVGCPILLAMKYLAYSSLPGADTMLYFYFYEQEASLAVCNICRQKFHWVLYQISHLYRGVIVDNFLLHPDGRFTWTIFFLSWVKQNSLVDFFFGTESRSVALLPRLECSGAMSKGQLIVIYITQT

SEQ ID NO: 830518 - protein, 208 aa, Homo sapiens
MPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 830519 - protein, 231 aa, Homo sapiens
MPEAAVKSTANKYQVFFFGTHETAFLGPKDLFPYEESKEKFGKPNKRKGFSEGLWEIENNPTVKASGYQPPPSCTEPCLPGQWVYPGANPTESSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 830520 - protein, 132 aa, Homo sapiens
TTARYEAGVLIGRGGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 830521 - protein, 207 aa, Homo sapiens
MPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHER

SEQ ID NO: 830522 - protein, 208 aa, Homo sapiens; identical to SEQ ID NO: 830518

SEQ ID NO: 830523 - protein, 208 aa, Homo sapiens; identical to SEQ ID NO: 830518

SEQ ID NO: 830524 - protein, 208 aa, Homo sapiens; identical to SEQ ID NO: 830518

SEQ ID NO: 830525 - protein, 208 aa, Homo sapiens; identical to SEQ ID NO: 830518

SEQ ID NO: 830526 - protein, 208 aa, Homo sapiens; identical to SEQ ID NO: 830518

SEQ ID NO: 830527 - protein, 208 aa, Homo sapiens; identical to SEQ ID NO: 830518

SEQ ID NO: 830528 - protein, 208 aa, Homo sapiens; identical to SEQ ID NO: 830518

SEQ ID NO: 830529 - protein, 208 aa, Homo sapiens; identical to SEQ ID NO: 830518

SEQ ID NO: 830530 - protein, 208 aa, Homo sapiens; identical to SEQ ID NO: 830518

SEQ ID NO: 830531 - protein, 208 aa, Homo sapiens; identical to SEQ ID NO: 830518

SEQ ID NO: 830532 - protein, 208 aa, Homo sapiens; identical to SEQ ID NO: 830518

SEQ ID NO: 830533 - protein, 208 aa, Homo sapiens; identical to SEQ ID NO: 830518

SEQ ID NO: 830534 - protein, 208 aa, Homo sapiens; identical to SEQ ID NO: 830518

SEQ ID NO: 830535 - protein, 208 aa, Homo sapiens; identical to SEQ ID NO: 830518

SEQ ID NO: 830536 - protein, 208 aa, Homo sapiens; identical to SEQ ID NO: 830518

SEQ ID NO: 830537 - protein, 121 aa, Homo sapiens
MPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGNVFNKRKLQKKNFKDP

SEQ ID NO: 830538 - protein, 345 aa, Homo sapiens
EEEWGPGGGWRKRPRAEEGAIEFQTQTTARARTHRAGALPRSAPAPSVRRAGGDAVAAPELGPGATIEAGAARGPERSGAATAARANLGSRFPARRGARGARSPAMSRSNRQKEYKCGDLVFAKMKGYPHWPARIDEMPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 830539 - protein, 105 aa, Homo sapiens
MKRKRLPRKMLRPQASEIMRACSHQCFKRSPHPVPAAVWVLLGKLAMACKLGTPFPPQPALLFYSLFPLQAQPMEIDLDGAGHLALTSRSPYSYDLSQSHVFSLE

SEQ ID NO: 830540 - protein, 169 aa, Homo sapiens
KKLLFILDNLIKLFSHPPQLLALNPHLFLPSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 830541 - protein, 105 aa, Homo sapiens; identical to SEQ ID NO: 830539

SEQ ID NO: 830542 - protein, 208 aa, Homo sapiens; identical to SEQ ID NO: 830518

SEQ ID NO: 830543 - protein, 186 aa, Homo sapiens
MPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMESPWRLTWMGQATWLSPLGPHTPMI

SEQ ID NO: 830544 - protein, 208 aa, Homo sapiens; identical to SEQ ID NO: 830518

SEQ ID NO: 830545 - protein, 208 aa, Homo sapiens; identical to SEQ ID NO: 830518

SEQ ID NO: 830546 - protein, 208 aa, Homo sapiens; identical to SEQ ID NO: 830518

SEQ ID NO: 830547 - protein, 208 aa, Homo sapiens; identical to SEQ ID NO: 830518

SEQ ID NO: 830548 - protein, 174 aa, Homo sapiens
MPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATGSTGGRPPSELLSPATPIIPAA

SEQ ID NO: 830549 - protein, 208 aa, Homo sapiens; identical to SEQ ID NO: 830518

SEQ ID NO: 830550 - protein, 128 aa, Homo sapiens
MPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDETTPIFPFADPKSFGSCS

SEQ ID NO: 830551 - protein, 208 aa, Homo sapiens; identical to SEQ ID NO: 830518

SEQ ID NO: 830552 - protein, 208 aa, Homo sapiens; identical to SEQ ID NO: 830518

SEQ ID NO: 830553 - protein, 236 aa, Homo sapiens
MPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHERLPFYLGLDDFLFVAGALMFLPVSFLIHIP

SEQ ID NO: 830554 - protein, 93 aa, Homo sapiens
RLGTRLGGWIDEMPEAAVKSTANKYQVFFFGTHETAFLGPKDLFPYEESKEKFGKPNKRKGFSEGLWEIENNPTVKASGYQSSQKKSCVEEQK

SEQ ID NO: 830555 - protein, 436 aa, Homo sapiens
MEPDDFDSEDKEILSWDINDVKLPQNVKKTDWFQEWPDSYAKHIYSSEDKNAQRHLSSWAMRNTNNHNSRILKKSCLGVVVCGRDCLAEEGRKIYLRPAICDKARQKQQRKRCPNCDGPLKLIPCRGHGGFPVTNFWRHDGRFIFFQSKGEHDHPKPETKLEAEARRAMKKVNTAPSSVSLSLKGSTETRSLPGETQSQGSLPLTWSFQEGVQLPGSYSGHLIANTPQQNSLNDCFSFSKSYGLGGITDLTDQTSTVDPMKLYEKRKLSSSRTYSSGDLLPPSASGVYSDHGDLQAWSKNAALGRNHLADNCYSNYPFPLTSWPCSFSPSQNSSEPFYQQLPLEPPAAKTGCPPLWPNPAGNLYEEKVHVDFNSYVQSPAYHSPQEDPFLFTYASHPHQQYSLPSKSSKWDFEEEMTYLGLDHCNNDMLLNLCPLR

SEQ ID NO: 830556 - protein, 240 aa, Homo sapiens
MAMASVKLLAGVLRKPDAWIGLWGVLRGTPSSYKLCTSWNRYLYFSSTKLRAPNYKTLFYNIFSLRLPGLLLSPECIFPFSVRLKSNIRSTKSTKKSLQKVDEEDSDEESHHDEMSEQEEELEDDPTVVKNYKDLEKAVQSFRYDVVLKTGLDIGRNKVEDAFYKGELRLNEEKLWKKSRTVKVGDTLDLLIGEDKEAGTETVMRILLKKVFEEKTESEKYRVVLRRWKSLKLPKKRMSK

SEQ ID NO: 830557 - protein, 240 aa, Homo sapiens; identical to SEQ ID NO: 830556

SEQ ID NO: 830558 - protein, 190 aa, Homo sapiens
GAHRPPPPAPGHQAPPWTRTSCEGSVRTLAEPNRAESCPSRPFAMVDELVLLLHALLMRHRALSIENSQLMEQLRLLVCERASLLRQVRPPSCPVPFPETFNGESSRLPEFIVQTASYMLVNENRFCNDAMKVAFLISLLTGEAEEWVVPYIEMDSPILGDYRAFLDEMKQCFGWDDDEDDDDEEEEDDY

SEQ ID NO: 830559 - protein, 190 aa, Homo sapiens; identical to SEQ ID NO: 830558

SEQ ID NO: 830560 - protein, 142 aa, Homo sapiens
SLALSPSLECSGAISAHCKLGRSSFLTAFGHWSQGYRPTVPASAGLGGGAQPQREELGRVDLSASKPTLAPQSVPPWLRGLSPERDLRGRSVLGSEEGVMLRSASRLCPNRTGLSLTPSPAAQLGFPQKRRASSSPGSRLLS

SEQ ID NO: 830561 - protein, 404 aa, Homo sapiens
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 830562 - protein, 1130 aa, Homo sapiens
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 830563 - protein, 1190 aa, Homo sapiens
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKHSGRHAELAEEMTFFPKEERVFSDKGCKTVFTKLDYYYDDCTVMIGSRSHCLELEKNNTQSFHTSTPV

SEQ ID NO: 830564 - protein, 156 aa, Homo sapiens
IRHGRRGQRGKMELVQVLKRGLQQITGHGGLRGYLRVFFRTNDAKVGTLVGEDKYGNKYYEDNKQFFGRHRWVVYTTEMNGKNTFWDVDGSMVPPEWHRWLHSMTDDPPTTKPLTARKFIWTNHKFNVTGTPEQYVPYSTTRKKIQEWIPPSTPYK

SEQ ID NO: 830565 - protein, 156 aa, Homo sapiens; identical to SEQ ID NO: 830564

SEQ ID NO: 830566 - protein, 74 aa, Homo sapiens
IRHGRRGQRGKMELVQVLKRGLQQITGHGGLRGYLRVFFRTNDAKVGTLVGEDKYGNKYYEDNKQFFGIVGFTV

SEQ ID NO: 830567 - protein, 156 aa, Homo sapiens; identical to SEQ ID NO: 830564

SEQ ID NO: 830568 - protein, 180 aa, Homo sapiens
IRHGRRGQRGKMELVQVLKRGLQQITGHGGLRGYLRVFFRTNDAKVGTLVGEDKYGNKYYEDNKQFFDEETEAKEVSLPKRLNHVINGRTWGRHRWVVYTTEMNGKNTFWDVDGSMVPPEWHRWLHSMTDDPPTTKPLTARKFIWTNHKFNVTGTPEQYVPYSTTRKKIQEWIPPSTPYK

SEQ ID NO: 830569 - protein, 147 aa, Homo sapiens
HSVSKYRHNGGTREAGPSKANWSYYRSLNVSTNDAKVGTLVGEDKYGNKYYEDNKQFFGRHRWVVYTTEMNGKNTFWDVDGSMVPPEWHRWLHSMTDDPPTTKPLTARKFIWTNHKFNVTGTPEQYVPYSTTRKKIQEWIPPSTPYK

SEQ ID NO: 830570 - protein, 69 aa, Homo sapiens
SVPLEFATEWHRWLHSMTDDPPTTKPLTARKFIWTNHKFNVTGTPEQYVPYSTTRKKIQEWIPPSTPYK

SEQ ID NO: 830571 - protein, 156 aa, Homo sapiens; identical to SEQ ID NO: 830564

SEQ ID NO: 830572 - protein, 82 aa, Homo sapiens
RSREANLGPAGLARIDPYGFERPEDFDDAAYEKFFSSYLVTLTRRAIKWSRLLQGGGVPRSRTANIHQEPLGRQLPLPPWKD

SEQ ID NO: 830573 - protein, 120 aa, Homo sapiens
MVNTLIILRATKCNREFLSHPWPPSPIEMTAGDCPSVPLRSRSPRLVLQFALRAGEVRGKSCGCDLEVGYSGEWYFAAVVERPQAVGFLQSWVYTHLSVMAGGDCCESILELVQKAAVCW

SEQ ID NO: 830574 - protein, 365 aa, Homo sapiens
MVKWAWGRFCSQSGLCSVERERRAEFLKEYMYQFWWRWTKFWVSLIFDLRRELVRVESVAGTRGPRRPLVQLTRCPSSRPSVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQVCGAARGSVPSQGAPPHLQPGGCSDHPEGAQDGHQWA

SEQ ID NO: 830575 - protein, 357 aa, Homo sapiens
PGAGRRTWDPLASLGARLPPRMQPAERSRVPRIDPYGFERPEDFDDAAYEKFFSSYLVTLTRRAIKWSRLLQGGGVPRSRTVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQKIFSEPGSLSMATVAKLRESCRARLLAQG

SEQ ID NO: 830576 - protein, 164 aa, Homo sapiens [sequence omitted]

SEQ ID NO: 830577 - protein, 365 aa, Homo sapiens
PGAGRRTWDPLASLGARLPPRMQPAERSRVPRIDPYGFERPEDFDDAAYEKFFSSYLVTLTRRAIKWSRLLQGGGVPRSRTVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQVCGAARGSVPSQGAPPHLQPGGCSDHPEGAQDGHQWA

SEQ ID NO: 830578 - protein, 269 aa, Homo sapiens
RGSPVLVVLPSILIFLHISLIITFTATELIIFYIFFETTLIPTLAIITRGGNQPERLNASTTNTVLVVLPVLVVLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQKIFSEPGSLSMATVAKLRESCRARLLAQG

SEQ ID NO: 830579 - protein, 357 aa, Homo sapiens; identical to SEQ ID NO: 830575

SEQ ID NO: 830580 - protein, 106 aa, Homo sapiens [sequence omitted]

SEQ ID NO: 830581 - protein, 754 aa, Homo sapiens
PPDTLREDDEGGHAPPQPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830582 - protein, 751 aa, Homo sapiens
MLRVPGHGFPAPFRPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830583 - protein, 751 aa, Homo sapiens; identical to SEQ ID NO: 830582

SEQ ID NO: 830584 - protein, 751 aa, Homo sapiens; identical to SEQ ID NO: 830582

SEQ ID NO: 830585 - protein, 751 aa, Homo sapiens; identical to SEQ ID NO: 830582

SEQ ID NO: 830586 - protein, 751 aa, Homo sapiens; identical to SEQ ID NO: 830582

SEQ ID NO: 830587 - protein, 698 aa, Homo sapiens
MVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830588 - protein, 762 aa, Homo sapiens
EPTGGKLGEQVLDLFNLNYILFGGVHSEEKEELVTKSNSLLSLKQGEGKGVEDIKGVSGGEPPKEVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830589 - protein, 615 aa, Homo sapiens
QTMRRTLKKEDIQNETVYCLNDDDETEVLKEDIIQGFSALGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830590 - protein, 484 aa, Homo sapiens
SSTENSHWRIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830591 - protein, 365 aa, Homo sapiens
VNPAPRCSLFGICKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830592 - protein, 751 aa, Homo sapiens; identical to SEQ ID NO: 830582

SEQ ID NO: 830593 - protein, 705 aa, Homo sapiens
MLRVPGHGFPAPFRPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQVIVIFWLVYYFFCGLTDLCILHTCFEVSGK

SEQ ID NO: 830594 - protein, 751 aa, Homo sapiens; identical to SEQ ID NO: 830582

SEQ ID NO: 830595 - protein, 537 aa, Homo sapiens
MLRVPGHGFPAPFRPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFLFRRAAL

SEQ ID NO: 830596 - protein, 106 aa, Homo sapiens
PAAATLPPYGHSISRSGYFASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830597 - protein, 375 aa, Homo sapiens
MLRVPGHGFPAPFRPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGMSVRVFTVA

SEQ ID NO: 830598 - protein, 345 aa, Homo sapiens
MLRVPGHGFPAPFRPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKKEGLFQ

SEQ ID NO: 830599 - protein, 751 aa, Homo sapiens; identical to SEQ ID NO: 830582

SEQ ID NO: 830600 - protein, 728 aa, Homo sapiens
YPQRRTCQRDFATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830601 - protein, 751 aa, Homo sapiens; identical to SEQ ID NO: 830582

SEQ ID NO: 830602 - protein, 751 aa, Homo sapiens; identical to SEQ ID NO: 830582

SEQ ID NO: 830603 - protein, 715 aa, Homo sapiens
GEDLNLRLGTKAWVSGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITQRGSLWKFCHS

SEQ ID NO: 830604 - protein, 646 aa, Homo sapiens
MLRVPGHGFPAPFRPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSRVTSS

SEQ ID NO: 830605 - protein, 360 aa, Homo sapiens
MLRVPGHGFPAPFRPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETESSR

SEQ ID NO: 830606 - protein, 751 aa, Homo sapiens; identical to SEQ ID NO: 830582

SEQ ID NO: 830607 - protein, 751 aa, Homo sapiens; identical to SEQ ID NO: 830582

SEQ ID NO: 830608 - protein, 751 aa, Homo sapiens; identical to SEQ ID NO: 830582

SEQ ID NO: 830609 - protein, 751 aa, Homo sapiens; identical to SEQ ID NO: 830582

SEQ ID NO: 830610 - protein, 751 aa, Homo sapiens; identical to SEQ ID NO: 830582

SEQ ID NO: 830611 - protein, 72 aa, Homo sapiens
YPQRRTCQRDFATRQVPARKKRPKRLRTGNMVRSGNKAAVVLCMDVGFTMSNSIPGIESPFEQAKKPRKRIK

SEQ ID NO: 830612 - protein, 540 aa, Homo sapiens
MLRVPGHGFPAPFRPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFLTFPGASPPS

SEQ ID NO: 830613 - protein, 267 aa, Homo sapiens
TGAGLRARPEEGGAAGLVREVTTGFGESIMAARTGHTALRRVVSGCRPKSATAAGAQAPVRNGRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 830614 - protein, 170 aa, Homo sapiens
RQADGNVYGQRVSATCNPEGKKGRVRLRRRPVHWLEETGAGLRARPEEGGAAGLVREVTTGFGESIMAARTGHTALRRVVSGCRPKSATAAGAQAPVRNGRYINSGGAETRVVFDFGCRVGGPEGFGGEAEPDSVHFRVFRGEGFFLRLASEGLKSGAHHLGPKAVFVAR

SEQ ID NO: 830615 - protein, 267 aa, Homo sapiens; identical to SEQ ID NO: 830613

SEQ ID NO: 830616 - protein, 259 aa, Homo sapiens
TGAGLRARPEEGGAAGLVREVTTGFGESIMAARTGHTALRRSATAAGAQAPVRNGRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 830617 - protein, 602 aa, Homo sapiens
SGSFHLRRPGRHLAVDVVPSQQITPAALPDPRRPVSPPAPSSQWFLLQLPWAPRPVVQPVEPRLCPSPLGGPSARADTHSAGEGEASRGWCGTCRPQQRRRAKPRAGQTKEAARVGRHGRRRRSAAMAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 830618 - protein, 104 aa, Homo sapiens
MGVSGEEASETEGEDKPAGWVQVSWLRPYPLPGLTYSYGKHDGGTMKIQQENTQFLYPKAFPVLVSQLGQHSLNKAKFHLCAALRGCYTTLYHPGIIYNAEFFE

SEQ ID NO: 830619 - protein, 97 aa, Homo sapiens
LSGLPLLLPVPLLLPVPRSAHEYSSSPDDAIFQSLARAYSSFNPAMSDPNYCRFLYYIGLVLAFLLALSKITHASIPVPVSSPSKSPRSKGTSIKHA

SEQ ID NO: 830620 - protein, 602 aa, Homo sapiens; identical to SEQ ID NO: 830617

SEQ ID NO: 830621 - protein, 421 aa, Homo sapiens
SGSFHLRRPGRHLAVDVVPSQQITPAALPDPRRPVSPPAPSSQWFLLQLPWAPRPVVQPVEPRLCPSPLGGPSARADTHSAGEGEASRGWCGTCRPQQRRRAKPRAGQTKEAARVGRHGRRRRSAAMAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKFLLCFLPISMEETLWPIIHMMRRGVVVLTNTAPPQMTPFSKAWPGHTLLSTRPCLTPIGHHVARMMMTAAL

SEQ ID NO: 830622 - protein, 583 aa, Homo sapiens
SGSFHLRRPGRHLAVDVVPSQQITPAALPDPRRPVSPPAPSSQWFLLQLPWAPRPVVQPVEPRLCPSPLGGPSARADTHSAGEGEASRGWCGTCRPQQRRRAKPRAGQAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 830623 - protein, 602 aa, Homo sapiens; identical to SEQ ID NO: 830617

SEQ ID NO: 830624 - protein, 358 aa, Homo sapiens
IFISDRNICRAETRKTFLRENFEHIQHIVIDEAQNFRTEDGDWYEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 830625 - protein, 230 aa, Homo sapiens
MSLVKSKRQLNPRGAIHSSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 830626 - protein, 397 aa, Homo sapiens
SGSFHLRRPGRHLAVDVVPSQQITPAALPDPRRPVSPPAPSSQWFLLQLPWAPRPVVQPVEPRLCPSPLGGPSARADTHSAGEGEASRGWCGTCRPQQRRRAKPRAGQTKEAARVGRHGRRRRSAAMAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSDADTGLPR

SEQ ID NO: 830627 - protein, 295 aa, Homo sapiens
SGSFHLRRPGRHLAVDVVPSQQITPAALPDPRRPVSPPAPSSQWFLLQLPWAPRPVVQPVEPRLCPSPLGGPSARADTHSAGEGEASRGWCGTCRPQQRRRAKPRAGQTKEAARVGRHGRRRRSAAMAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSCDPMGLESGVFAC

SEQ ID NO: 830628 - protein, 602 aa, Homo sapiens; identical to SEQ ID NO: 830617

SEQ ID NO: 830629 - protein, 581 aa, Homo sapiens
SGSFHLRRPGRHLAVDVVPSQQITPAALPDPRRPVSPPAPSSQWFLLQLPWAPRPVVQPVEPRLCPSPLGGPSARADTHSAGEGEASRGWCGTCRPQQRRRAKPRAGQTKEAARVGRHGRRRRSAAMAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 830630 - protein, 440 aa, Homo sapiens
MRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 830631 - protein, 341 aa, Homo sapiens
VILDDPLLSEIQILLSDSASYLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 830632 - protein, 287 aa, Homo sapiens
GEGDEGGRGEGEERGGRGGDAEGTTRDGGGRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKFLLCFLPISMEETLWPIIHMMRRGVVVLTNTAPPQMTPFSKAWPGHTLLSTRPCLTPIGHHVARMMMTAAL

SEQ ID NO: 830633 - protein, 255 aa, Homo sapiens
SGSFHLRRPGRHLAVDVVPSQQITPAALPDPRRPVSPPAPSSQWFLLQLPWAPRPVVQPVEPRLCPSPLGGPSARADTHSAGEGEASRGWCGTCRPQQRRRAKPRAGQTKEAARVGRHGRRRRSAAMAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPDCKLYEVGTLIPAPSSCLAHSGLEYTL

SEQ ID NO: 830634 - protein, 469 aa, Homo sapiens
PSAEAPAERPRMEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 830635 - protein, 365 aa, Homo sapiens
PSAEAPAERPRMEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATETSFRWHLLGKSSLMSRS

SEQ ID NO: 830636 - protein, 133 aa, Homo sapiens
ISVRCDLLLLVFCHDCEASPTTWNCGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 830637 - protein, 122 aa, Homo sapiens
MIPTPEVVLPNGIGGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 830638 - protein, 444 aa, Homo sapiens
MIEDNKENKDHSLERGRASLIFSLKNEVGGLIKALKIFQEKHVNLLHIESRKSKRRNSEFEIFVDCDINREQLNDIFHLLKSHTNVLSVNLPDNFTLKEDGMETVPWFPKKISDLDHCANRVLMYGSELDADHPGFKDNVYRKRRKYFADLAMNYKHGDPIPKVEFTEEEIKTWGTVFQELNKLYPTHACREYLKNLPLLSKYCGYREDNIPQLEDVSNFLKERTGFSIRPVAGYLSPRDFLSGLAFRVFHCTQYVRHSSDPFYTPEPDTCHELLGHVPLLAEPSFAQFSQEIGLASLGASEEAVQKLATCYFFTVEFGLCKQDGQLRVFGAGLLSSISELKHALSGHAKVKPFDPKITCKQECLITTFQDVYFVSESFEDAKEKMREFTKTIKRPFGVKYNPYTRSIQILKDTKSITSAMNELQHDLDVVSDALAKVSRKPSI

SEQ ID NO: 830639 - protein, 344 aa, Homo sapiens
MLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 830640 - protein, 875 aa, Homo sapiens
MIEDNKENKDHSLERGRASLIFSLKNEVGGLIKALKIFQEKHVNLLHIESRKSKRRNSEFEIFVDCDINREQLNDIFHLLKSHTNVLSVNLPDNFTLKEDGMETVPWFPKKISDLDHCANRVLMYGSELDADHPGFKDNVYRKRRKYFADLAMNYKHGDPIPKVEFTEEEIKTWGTVFQELNKLYPTHACREYLKNLPLLSKYCGYREDNIPQLEDVSNFLKERTGFSIRPVAGYLSPRDFLSGLAFRVFHCTQYVRHSSDPFYTPEPDTCHELLGHVPLLAEPSFAQFSQEIGLASLGASEEAVQKLATCYFFTVEFGLCKQDGQLRVFGAGLLSSISELKHALSGHAKVKPFDPKITCKQECLITTFQDVYFVSESFEDAKEKMREFTKTIKRPFGVKYNPYTRSIQILKDTKSITSAMNELQHDLDVVSDALAKGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 830641 - protein, 541 aa, Homo sapiens
DSLIFVFKHALSGHAKVKPFDPKITCKQECLITTFQDVYFVSESFEDAKEKMREFTKTIKRPFGVKYNPYTRSIQILKDTKSITSAMNELQHDLDVVSDALAKGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 830642 - protein, 278 aa, Homo sapiens
PSAEAPAERPRMEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTDAGEVYVWGSNKHGQLANEAAFLPVPQKIEAHCFQNEKVTAIWSGWTHLVAQTGLLWLRA

SEQ ID NO: 830643 - protein, 901 aa, Homo sapiens
MIEDNKENKDHSLERGRASLIFSLKNEVGGLIKALKIFQEKHVNLLHIESRKSKRRNSEFEIFVDCDINREQLNDIFHLLKSHTNVLSVNLPDNFTLKEDGMETVPWFPKKISDLDHCANRVLMYGSELDADHPGFKDNVYRKRRKYFADLAMNYKHGDPIPKVEFTEEEIKTWGTVFQELNKLYPTHACREYLKNLPLLSKYCGYREDNIPQLEDVSNFLKERTGFSIRPVAGYLSPRDFLSGLAFRVFHCTQYVRHSSDPFYTPEPDTCHELLGHVPLLAEPSFAQFSQEIGLASLGASEEAVQKLATCYFFTVEFGLCKQDGQLRVFGAGLLSSISELKHALSGHAKVKPFDPKITCKQECLITTFQDVYFVSESFEDAKEKMREFTKTIKRPFGVKYNPYTRSIQILKDTKSITSAMNELQHDLDVVSDALAKGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATGQHYWLWQLRLRCFVSPLVEWRKERGASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 830644 - protein, 237 aa, Homo sapiens
MLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGT

SEQ ID NO: 830645 - protein, 239 aa, Homo sapiens
PSAEAPAERPRMEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTASRVTGKMLLSLVLYLFFVRK

SEQ ID NO: 830646 - protein, 299 aa, Homo sapiens
PSAEAPAERPRMEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTGLLWLRA

SEQ ID NO: 830647 - protein, 265 aa, Homo sapiens
PSAEAPAERPRMEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTDAGEVYVWGSNKHGQLANEAAFLPVPSSSALAPSVLAPAPGRGLRPR

SEQ ID NO: 830648 - protein, 121 aa, Homo sapiens
MLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTGRYQLFH

SEQ ID NO: 830649 - protein, 444 aa, Homo sapiens; identical to SEQ ID NO: 830638

SEQ ID NO: 830650 - protein, 444 aa, Homo sapiens; identical to SEQ ID NO: 830638

SEQ ID NO: 830651 - protein, 344 aa, Homo sapiens; identical to SEQ ID NO: 830639

SEQ ID NO: 830652 - protein, 244 aa, Homo sapiens
MCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 830653 - protein, 349 aa, Homo sapiens
MGNWGLVTQRISHILPPANPSLAVPSNRWPVAGILRLCSQLHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 830654 - protein, 376 aa, Homo sapiens
SGRPRPAELPRSPAASPRLVSLPTMEGVAVVTAGSVGAAKTEGAAALPPPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNIRLDRQLQDIVYKLVINLEEREKKQMHDFYKERGLEVPKPAVPQPVPSSKGRSKKVLESVFRIPPELDMSLLLEFIGANEGTGHFKPLEKKFVRVSGEATIGHVEKFLRRKMGLDPACQVDIICGDHLLEQYQTLREIRRAIGDAAMQDGLLVLHYGLVVSPLKIT

SEQ ID NO: 830655 - protein, 383 aa, Homo sapiens
SGRPRPAELPRSPAASPRLVSLPTMEGVAVVTAGSVGAAKTEGAAALPPPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNIRLDRQLQDIVYKLVINLEEICVLSFFGEKKQMHDFYKERGLEVPKPAVPQPVPSSKGRSKKVLESVFRIPPELDMSLLLEFIGANEGTGHFKPLEKKFVRVSGEATIGHVEKFLRRKMGLDPACQVDIICGDHLLEQYQTLREIRRAIGDAAMQDGLLVLHYGLVVSPLKIT

SEQ ID NO: 830656 - protein, 224 aa, Homo sapiens
SGRPRPAELPRSPAASPRLVSLPTMEGVAVVTAGSVGAAKTEGAAALPPPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNISCSTASPFKQRKI

SEQ ID NO: 830657 - protein, 287 aa, Homo sapiens
SGRPRPAELPRSPAASPRLVSLPTMEGVAVVTAGSVGAAKTEGAAALPPPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNIRLDRQLQDIVYKLVINLEEREKKQMHDFYKERGLEVPKPAVPQPVPSSKGRSKKVLESVFRIPPELDMSLLLEFIG

SEQ ID NO: 830658 - protein, 376 aa, Homo sapiens; identical to SEQ ID NO: 830654

SEQ ID NO: 830659 - protein, 189 aa, Homo sapiens
MEGVAVVTAGSVGAAKTEGAAALPPPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNIRC

SEQ ID NO: 830660 - protein, 188 aa, Homo sapiens
MEGVAVVTAGSVGAAKTEGAAALPPPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNIR

SEQ ID NO: 830661 - protein, 196 aa, Homo sapiens
AAAVAELPVLDARGQRVPFGALFRERRAVVVFVRHFLCYICKEYVEDLAKIPRSFLQEANVTLIVIGQSSYHHIEPFCKLTGYSHEIYVDPEREIYKRLGMKRGEEIASSGQSPHIKSNLLSGSLQSLWRAVTGPLFDFQGDPAQQGGTLILGPGNNIHFIHRDRNRLDHKPINSVLQLVGVQHVNFTNRPSVIHV

SEQ ID NO: 830662 - protein, 196 aa, Homo sapiens; identical to SEQ ID NO: 830661

SEQ ID NO: 830663 - protein, 106 aa, Homo sapiens
AAASQLGRGRERARARPASHAPGARAAGPGPAGVAFARVTHGEVQGSFGARGCCFTNLPFLPFWLSAFPVLHLQGIRRGSGQNPQEFLTRSKCHPYSDWTVILPSY

SEQ ID NO: 830664 - protein, 152 aa, Homo sapiens
AAAVAELPVLDARGQRVPFGALFRERRAVVVFVRHFLCYICKEYVEDLAKIPRSFLQEANVTLIVIGQSSYHHIEPFCKLTGYSHEIYVDPEREIYKRLGMKRGEEIASSGNNIHFIHRDRNRLDHKPINSVLQLVGVQHVNFTNRPSVIHV

SEQ ID NO: 830665 - protein, 179 aa, Homo sapiens
GPRPPRVMAAPAPVTRQHFLCYICKEYVEDLAKIPRSFLQEANVTLIVIGQSSYHHIEPFCKLTGYSHEIYVDPEREIYKRLGMKRGEEIASSGQSPHIKSNLLSGSLQSLWRAVTGPLFDFQGDPAQQGGTLILGPGNNIHFIHRDRNRLDHKPINSVLQLVGVQHVNFTNRPSVIHV

SEQ ID NO: 830666 - protein, 109 aa, Homo sapiens
MSLNPPIFLKRSEENSSKFVETKQSQTTSIASEDPLQNLCLASQEVLQKAQQSGRSKCLKCGGSRMFYCYTCYVPVENVPIEQIPLVKFSLYHLGQSMVSSASKITCIG

SEQ ID NO: 830667 - protein, 65 aa, Homo sapiens
MGTVYFNPGLLQVELKTRKTCFWRHQKGKPDTFLSTIEAIYYFLVDYHTDILKEKYRGGLVGLKG

SEQ ID NO: 830668 - protein, 190 aa, Homo sapiens
MSLNPPIFLKRSEENSSKFVETKQSQTTSIASEDPLQNLCLASQEVLQKAQQSGRSKCLKCGGSRMFYCYTCYVPVENVPIEQIPLVKLPLKIDIIKHPNETDGKSTAIHAKLLAPEFVNIYTYPCIPEYEEKDHEVALIFPGPQSISIKDISFHLQKRIQNNVRGKNDDPDKPSFKRKRTEEQEFCDCE

SEQ ID NO: 830669 - protein, 190 aa, Homo sapiens; identical to SEQ ID NO: 830668

SEQ ID NO: 830670 - protein, 190 aa, Homo sapiens; identical to SEQ ID NO: 830668

SEQ ID NO: 830671 - protein, 190 aa, Homo sapiens; identical to SEQ ID NO: 830668

SEQ ID NO: 830672 - protein, 125 aa, Homo sapiens
MFYCYTCYVPVENVPIEQIPLVKLPLKIDIIKHPNETDGKSTAIHAKLLAPEFVNIYTYPCIPEYEEKDHEVALIFPGPQSISIKDISFHLQKRIQNNVRGKNDDPDKPSFKRKRTEEQEFCDCE

SEQ ID NO: 830673 - protein, 190 aa, Homo sapiens; identical to SEQ ID NO: 830668

SEQ ID NO: 830674 - protein, 172 aa, Homo sapiens
MSLNPPIFLKRSEENSSKFVETKQSQTTSIASEDPLQNLCLASQEVLQKAQQSGRSKCLKCGGSRMFYCYTCYVPVENVPIEQIPLVKLPLKIDIIKHPNETDGKSTAIHAKLLAPEFVNIYTYPCIPEYEEKDHEGWTHFAGTQYLNKEFLFICKGVPYGGEMYLEPFKQN

SEQ ID NO: 830675 - protein, 190 aa, Homo sapiens; identical to SEQ ID NO: 830668

SEQ ID NO: 830676 - protein, 190 aa, Homo sapiens; identical to SEQ ID NO: 830668

SEQ ID NO: 830677 - protein, 112 aa, Homo sapiens
MSLNPPIFLKRSEENSSKFVETKQSQTTSIASEDPLQNLCLASQEVLQKAQQSGRSKCLKCGGSRMFYCYTCYVPVENVPIEQIPLVKMGPSSCRKTSSGILLILHYASIED

SEQ ID NO: 830678 - protein, 190 aa, Homo sapiens; identical to SEQ ID NO: 830668

SEQ ID NO: 830679 - protein, 481 aa, Homo sapiens
MGNVNRQGQHCRDFIMVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 830680 - protein, 227 aa, Homo sapiens
MVLLLVNGAQLCGGTLINTIWVVSAAHCFEEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 830681 - protein, 459 aa, Homo sapiens
MGNVNRQGQHCRDFIMVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 830682 - protein, 505 aa, Homo sapiens
PGPRRLLLAGIDPQPHVYAAAPAAPFGPASARAPERALGISPRKQRGQAGKDGRRGWLTREHGREDTQPGPRAAPLPSSRTGGNLRCPRRVGRGAVSEALGGARGGRFTELHFPVFVTQEEAHGVLHRRRRANAFLEELRPGSLERECKEEQCSFEEAREIFKDAERTGEWMITTSPACNPSQLTDTSPPTDGDQCASSPCQNGGSCKDQLQSYICFCLPAFEGRNCETLEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 830683 - protein, 2193 aa, Homo sapiens
QLRERGFISARFRNWQAYMQYCVLCDKEFLGHRIVRHAQKHYKDGIYSCPICAKNFNSKETFVPHVTLHVKQSSKERLAAMKPLRRLGRPPKITTTNENQKTNTVAKQEQRPIKKNSLYSTDFIVFNDNDGSDDENDDKDKSYEPEVIPVQKPVPVNEFNCPVTFCKKGFKYFKNLIAHVKGHKDNEDAKRFLEMQSKKVICQYCRRHFVSVTHLNDHLQMHCGSKPYICIQMKCKAGFNSYAELLTHRKEHQVFRAKCMFPKCGRIFSEAYLLYDHEAQHYNTYTCKFTGCGKVYRSQGELEKHLDDHSTPPEKVLPPEAQLNSSGDSIQPSEVNQNTAENIEKERSMLPSENNIENSLLADRSDAWDKSKAESAVTKQDQISASELRQANGPLSNGLENPATTPLLQSSEVAVSIKVSLNQGIEDNFGKQENSTVEGSGEALVTDLHTPVEDTCNDLCHPGFQERKEQDCFNDAHVTQNSLVNSETLKIGDLTPQNLERQVNNLMTFSVQNQAAFQNNLPTSKFECGDNVKTSSNLYNLPLKTLESIAFVPPQSDLSNSLGTPSVPPKAPVQKFSCQVEGCTRTYNSSQSIGKHMKTAHPDQYAAFKMQRKSKKGQKANNFVYFLPSPVNSSNPFFTSQTKANGNPACSAQLQHVSPPIFPAHLASVSTPLLSSMESVINPNITSQDKNEQGGMLCSQMENLPSTALPAQMEDLTKTVLPLNIDSGSDPFLPLPAESSSMSLFPSPADSGTNSVFSQLENNTNHYSSQIEGNTNSSFLKGGNGENAVFPSQVNVANNFSSTNAQQSAPEKVKKDRGRGPNGKERKPKHNKRAKWPAIIRDGKFICSRCYRAFTNPRSLGGHLSKRSYCKPLDGAEIAQELLQSNGQPSLLASMILSTNAVNLQQPQQSTFNPEACFKDPSFLQLLAENRSPAFLPNTFPRSGVTNFNTSVSQEGSEIIKQALETAGIPSTFEGAEMLSHVSTGCVSDASQVNATVMPNPTVPPLLHTVCHPNTLLTNQNRTSNSKTSSIEECSSLPVFPTNDLLLKTVENGLCSSSFPNSGGPSQNFTSNSSRVSVISGPQNTRSSHLNKKGNSASKRRKKVAPPLIAPNASQNLVTSDLTTMGLIAKSVEIPTTNLHSNVIPTCEPQSLVENLTQKLNNVNNQLFMTDVKENFKTSLESHTVLAPLTLKTENGDSQMMALNSCTTSINSDLQISEDNVIQNFEKTLEIIKTAMNSQILEVKSGSQGAGETSQNAQINYNIQLPSVNTVQNNKLPDSSPFSSFISVMPTKSNIPQSEVSHKEDQIQEILEGLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 830684 - protein, 1647 aa, Homo sapiens
MIPTGRCTGTPSVPPKAPVQKFSCQVEGCTRTYNSSQSIGKHMKTAHPDQYAAFKMQRKSKKGQKANNLNTPNNGKFVYFLPSPVNSSNPFFTSQTKANGNPACSAQLQHVSPPIFPAHLASVSTPLLSSMESVINPNITSQDKNEQGGMLCSQMENLPSTALPAQMEDLTKTVLPLNIDSGSDPFLPLPAESSSMSLFPSPADSGTNSVFSQLENNTNHYSSQIEGNTNSSFLKGGNGENAVFPSQVNVANNFSSTNAQQSAPEKVKKDRGRGPNGKERKPKHNKRAKWPAIIRDGKFICSRCYRAFTNPRSLGGHLSKRSYCKPLDGAEIAQELLQSNGQPSLLASMILSTNAVNLQQPQQSTFNPEACFKDPSFLQLLAENRSPAFLPNTFPRSGVTNFNTSVSQEGSEIIKQALETAGIPSTFEGAEMLSHVSTGCVSDASQVNATVMPNPTVPPLLHTVCHPNTLLTNQNRTSNSKTSSIEECSSLPVFPTNDLLLKTVENGLCSSSFPNSGGPSQNFTSNSSRVSVISGPQNTRSSHLNKKGNSASKRRKKVAPPLIAPNASQNLVTSDLTTMGLIAKSVEIPTTNLHSNVIPTCEPQSLVENLTQKLNNVNNQLFMTDVKENFKTSLESHTVLAPLTLKTENGDSQMMALNSCTTSINSDLQISEDNVIQNFEKTLEIIKTAMNSQILEVKSGSQGAGETSQNAQINYNIQLPSVNTVQNNKLPDSSPFSSFISVMPTKSNIPQSEVSHKEDQIQEILEGLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 830685 - protein, 608 aa, Homo sapiens
PTLEYPPPTPRIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 830686 - protein, 641 aa, Homo sapiens
VELRRRRLRRGAAAPGRAAPGAGATAAGEPGTGRGSGHRLLSAAVPDTPRICREMENFRRSFTFIGEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 830687 - protein, 2201 aa, Homo sapiens
QLRERGFISARFRNWQAYMQYCVLCDKEFLGHRIVRHAQKHYKDGIYSCPICAKNFNSKETFVPHVTLHVKQSSKERLAAMKPLRRLGRPPKITTTNENQKTNTVAKQEQRPIKKNSLYSTDFIVFNDNDGSDDENDDKDKSYEPEVIPVQKPVPVNEFNCPVTFCKKGFKYFKNLIAHVKGHKDNEDAKRFLEMQSKKVICQYCRRHFVSVTHLNDHLQMHCGSKPYICIQMKCKAGFNSYAELLTHRKEHQVFRAKCMFPKCGRIFSEAYLLYDHEAQHYNTYTCKFTGCGKVYRSQGELEKHLDDHSTPPEKVLPPEAQLNSSGDSIQPSEVNQNTAENIEKERSMLPSENNIENSLLADRSDAWDKSKAESAVTKQDQISASELRQANGPLSNGLENPATTPLLQSSEVAVSIKVSLNQGIEDNFGKQENSTVEGSGEALVTDLHTPVEDTCNDLCHPGFQERKEQDCFNDAHVTQNSLVNSETLKIGDLTPQNLERQVNNLMTFSVQNQAAFQNNLPTSKFECGDNVKTSSNLYNLPLKTLESIAFVPPQSDLSNSLGTPSVPPKAPVQKFSCQVEGCTRTYNSSQSIGKHMKTAHPDQYAAFKMQRKSKKGQKANNLNTPNNGKFVYFLPSPVNSSNPFFTSQTKANGNPACSAQLQHVSPPIFPAHLASVSTPLLSSMESVINPNITSQDKNEQGGMLCSQMENLPSTALPAQMEDLTKTVLPLNIDSGSDPFLPLPAESSSMSLFPSPADSGTNSVFSQLENNTNHYSSQIEGNTNSSFLKGGNGENAVFPSQVNVANNFSSTNAQQSAPEKVKKDRGRGPNGKERKPKHNKRAKWPAIIRDGKFICSRCYRAFTNPRSLGGHLSKRSYCKPLDGAEIAQELLQSNGQPSLLASMILSTNAVNLQQPQQSTFNPEACFKDPSFLQLLAENRSPAFLPNTFPRSGVTNFNTSVSQEGSEIIKQALETAGIPSTFEGAEMLSHVSTGCVSDASQVNATVMPNPTVPPLLHTVCHPNTLLTNQNRTSNSKTSSIEECSSLPVFPTNDLLLKTVENGLCSSSFPNSGGPSQNFTSNSSRVSVISGPQNTRSSHLNKKGNSASKRRKKVAPPLIAPNASQNLVTSDLTTMGLIAKSVEIPTTNLHSNVIPTCEPQSLVENLTQKLNNVNNQLFMTDVKENFKTSLESHTVLAPLTLKTENGDSQMMALNSCTTSINSDLQISEDNVIQNFEKTLEIIKTAMNSQILEVKSGSQGAGETSQNAQINYNIQLPSVNTVQNNKLPDSSPFSSFISVMPTKSNIPQSEVSHKEDQIQEILEGLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 830688 - protein, 1853 aa, Homo sapiens
MLPSENNIENSLLADRSDAWDKSKAESAVTKQDQISASELRQANGPLSNGLENPATTPLLQSSEVAVSIKVSLNQGIEDNFGKQENSTVEGSGEALVTDLHTPVEDTCNDLCHPGFQERKEQDCFNDAHVTQNSLVNSETLKIGDLTPQNLERQVNNLMTFSVQNQAAFQNNLPTSKFECGDNVKTSSNLYNLPLKTLESIAFVPPQSDLSNSLGTPSVPPKAPVQKFSCQVEGCTRTYNSSQSIGKHMKTAHPDQYAAFKMQRKSKKGQKANNLNTPNNGKFVYFLPSPVNSSNPFFTSQTKANGNPACSAQLQHVSPPIFPAHLASVSTPLLSSMESVINPNITSQDKNEQGGMLCSQMENLPSTALPAQMEDLTKTVLPLNIDSGSDPFLPLPAESSSMSLFPSPADSGTNSVFSQLENNTNHYSSQIEGNTNSSFLKGGNGENAVFPSQVNVANNFSSTNAQQSAPEKVKKDRGRGPNGKERKPKHNKRAKWPAIIRDGKFICSRCYRAFTNPRSLGGHLSKRSYCKPLDGAEIAQELLQSNGQPSLLASMILSTNAVNLQQPQQSTFNPEACFKDPSFLQLLAENRSPAFLPNTFPRSGVTNFNTSVSQEGSEIIKQALETAGIPSTFEGAEMLSHVSTGCVSDASQVNATVMPNPTVPPLLHTVCHPNTLLTNQNRTSNSKTSSIEECSSLPVFPTNDLLLKTVENGLCSSSFPNSGGPSQNFTSNSSRVSVISGPQNTRSSHLNKKGNSASKRRKKVAPPLIAPNASQNLVTSDLTTMGLIAKSVEIPTTNLHSNVIPTCEPQSLVENLTQKLNNVNNQLFMTDVKENFKTSLESHTVLAPLTLKTENGDSQMMALNSCTTSINSDLQISEDNVIQNFEKTLEIIKTAMNSQILEVKSGSQGAGETSQNAQINYNIQLPSVNTVQNNKLPDSSPFSSFISVMPTKSNIPQSEVSHKEDQIQEILEGLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 830689 - protein, 2201 aa, Homo sapiens; identical to SEQ ID NO: 830687

SEQ ID NO: 830690 - protein, 883 aa, Homo sapiens
MQCLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 830691 - protein, 119 aa, Homo sapiens
MAARAVRFDRNLCAAGRKAQDSLSVRYAGLPDRSEMAEVEETLKRLQSQKGVQGIIVVNTEGIPIKSTMDNPTTTQYASLMHSFILKARSTVRLDIDPQNDLTFLRIRSKKNEIMVAPR

SEQ ID NO: 830692 - protein, 92 aa, Homo sapiens
ARAARAARVAEVEETLKRLQSQKGVQGIIVVNTEGIPIKSTMDNPTTTQYASLMHSFILKARSTVRLDIDPQNDLTFLRIRSKKNEIMVAPR

SEQ ID NO: 830693 - protein, 101 aa, Homo sapiens
EVNPAYLPLLTLVLFSGRAEVEETLKRLQSQKGVQGIIVVNTEGIPIKSTMDNPTTTQYASLMHSFILKARSTVRLDIDPQNDLTFLRIRSKKNEIMVAPR

SEQ ID NO: 830694 - protein, 99 aa, Homo sapiens
LGRGGVYLAESGSVGKAEVEETLKRLQSQKGVQGIIVVNTEGIPIKSTMDNPTTTQYASLMHSFILKARSTVRLDIDPQNDLTFLRIRSKKNEIMVAPR

SEQ ID NO: 830695 - protein, 137 aa, Homo sapiens
MMGEGWAAALQPRVLGPWCAMATLPTFPGSSVCGRLCQALYVSCISSASSQLCEAEVEETLKRLQSQKGVQGIIVVNTEGIPIKSTMDNPTTTQYASLMHSFILKARSTVRLDIDPQNDLTFLRIRSKKNEIMVAPR

SEQ ID NO: 830696 - protein, 97 aa, Homo sapiens
SARPVGPDRSEMARAEVEETLKRLQSQKGVQGIIVVNTEGIPIKSTMDNPTTTQYASLMHSFILKARSTVRLDIDPQNDLTFLRIRSKKNEIMVAPR

SEQ ID NO: 830697 - protein, 119 aa, Homo sapiens; identical to SEQ ID NO: 830691

SEQ ID NO: 830698 - protein, 119 aa, Homo sapiens; identical to SEQ ID NO: 830691

SEQ ID NO: 830699 - protein, 47 aa, Homo sapiens
MAEVEETLKRLQSQKGVQGIIVVNTEGGWEPLGHCGDRSRPPAQGCP

SEQ ID NO: 830700 - protein, 119 aa, Homo sapiens; identical to SEQ ID NO: 830691

SEQ ID NO: 830701 - protein, 69 aa, Homo sapiens
MATLPTFPGSSVCGRLCQALYVSCISSASSQLCEVDTIFSPILLYISVIQRPEKPSALPQEIVEMDLNP

SEQ ID NO: 830702 - protein, 99 aa, Homo sapiens; identical to SEQ ID NO: 830694

SEQ ID NO: 830703 - protein, 116 aa, Homo sapiens
MRQSPSLLVTTGGPLIDESLCKQDMRTWPAGKQTSRHGDNTGTHLGDLLCVRANPLIPVGRADNSMGTTTLPSRSNLTGPWRETLLPAVRAVNRWYNTAHMHTLIEIGLPNCTRHF

SEQ ID NO: 830704 - protein, 110 aa, Homo sapiens
ETESCTVAQAGDSGVILAHCSLHLSNSSDSPASASQVAGIIGARHPAWLIFVFLVKMGFCNIGQAGLKLLTSTELPPSGFQSVGIRGLSYWARANLETFFSFLVPQFSQM

SEQ ID NO: 830705 - protein, 100 aa, Homo sapiens
GYCRIRLYMSRIIGRKCAEVEETLKRLQSQKGVQGIIVVNTEGIPIKSTMDNPTTTQYASLMHSFILKARSTVRLDIDPQNDLTFLRIRSKKNEIMVAPR

SEQ ID NO: 830706 - protein, 104 aa, Homo sapiens
MAEVEETLKRLQSQKGVQGIIVVNTEVCRSLWPGAVAHACNPSTLEGRGGWIMRHSHQEHHGQPHHHPVCQPHAQLHPEGTEHRAVGHRPPERSHLPSNSLQEK

SEQ ID NO: 830707 - protein, 119 aa, Homo sapiens; identical to SEQ ID NO: 830691

SEQ ID NO: 830708 - protein, 252 aa, Homo sapiens
MKLHELSQFKLGLLQHFYFSNEDIMERINRLASLFYVFSNAVWNQFIDHFFQVICLHLSGHDFHHLLPDLADLLVLSIRGLPYLIVAFFSKTNTEQTKQVTIGSLDINVSFNHCLPFFDHGTHFVTGKIHAMEVSQAVFTLNIFSNQLEFSKCNFIILQISKTHFKHTTLETIRCNFGSLGPGDERLSNISYIEHSRCFHIIPIFLRKWINHFLLGSLFAAFRKALVLANHHGAWQVEAAVYCDHATAFQLG

SEQ ID NO: 830709 - protein, 203 aa, Homo sapiens
MISIIFFRIWLVLSIKVFRISQDLLVLSIRGLPYLIVAFFSKTNTEQTKQVTIGSLDINVSFNHCLPFFDHGTHFVTGKIHAMEVSQAVFTLNIFSNQLEFSKCNFIILQISKTHFKHTTLETIRCNFGSLGPGDERLSNISYIEHSRCFHIIPIFLRKWINHFLLGSLFAAFRKALVLANHHGAWQVEAAVYCDHATAFQLG

SEQ ID NO: 830710 - protein, 89 aa, Homo sapiens
HLVEHWRIHTGQKPYKCSECDKVFNRNSNLARHQRIHTGEKPHKCNECGKAFRECSGLTTHLVIHTGEKPYKCNECGKNFRHKFSLTNH

SEQ ID NO: 830711 - protein, 121 aa, Homo sapiens
KPYKCNECGKVFSLLSYLARHQIIHSTEKPYKCNECGRAFHKRPGLMAHLLIHTGEKPYKCNECDKVFGRKLYLTNHQRIHTGERPYKCNACGKVFNQNPHLSRHRKIHAGENSLRTLQME

SEQ ID NO: 830712 - protein, 957 aa, Homo sapiens
MSLVSQNSRRRRRRVAKATAHNSSWGEMQAPNAPGLPADVPGSDVPQGPSDSQILQGLCASEGPSTSVLPTSAEGPSTFVPPTISEASSASGQPTISEGPGTSVLPTPSEGLSTSGPPTISKGLCTSVTLAASEGRNTSRPPTSSEEPSTSVPPTASEVPSTSLPPTPGEGTSTSVPPTAYEGPSTSVVPTPDEGPSTSVLPTPGEGPGTSVPLAATEGLSTSVQATPDEGPSTSVPPTATEGLSTPVPPTRDEGPSTSVPATPGEGPSTSVLPAASDGQSISLVPTRGKGSSTSVPPTATEGLSTSVQPTAGEGSSTSVPPTPGGGLSTSVPPTATEELSTSVPPTPGEGPSTSVLPIPGEGLSTSVPPTASDGSDTSVPPTPGEGASTLVQPTAPDGPGSSVLPNPGEGPSTLFSSSASVDRNPSKCSLVLPSPRVTKASVDSDSEGPKGAEGPIEFEVLRDCESPNSISIMGLNTSRVAITLKPQDPMEQNVAELLQFLLVKDQSKYPIRESEMREYIVKEYRNQFPEILRRAAAHLECIFRFELRELDPEAHTYILLNKLGPVPFEGLEESPNGPKMGLLMMILGQIFLNGNQAKEAEIWEMLWRMGVQRERRLSIFGNPKRLLSVEFVWQRYLDYRPVTDCKPVEYEFFWGPRSHLETTKMKILKFMAKIYNKDPMDWPEKYNEALEEDAARAFAEGWQALPHFRRPFFEEAAAEVPSPDSEVSSYSSKYAPHSWPESRLESKARKLVQLFLLMDSTKLPIPKKGILYYIGRECSKVFPDLLNRAARTLNHVYGTELVVLDPRNHSYTLYNRREMEETEEIVDSPNRPGNNFLMQVLSFIFIMGNHARESAVWAFLRGLGVQAGRKHVITCRYLSQRYIDSLRVPDSDPVQYEFVWGPRARLETSKMKALRYVARIHRKEPQDWPQQYREAMEDEANRADVGHRQIFVHNFR

SEQ ID NO: 830713 - protein, 279 aa, Homo sapiens
VDLKKPELKIPHTVNFYLRVEPGVMLGIWHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDENVKFLSSPLLILHGEDDRTVPLEYGKKLYEIARNAYRNKERVKMVIFPPGFQHNLLCKSPTLLITVRDFLSKQWS

SEQ ID NO: 830714 - protein, 189 aa, Homo sapiens
VAAWWDMVDRNLRHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDEK

SEQ ID NO: 830715 - protein, 167 aa, Homo sapiens
VAAWWDMVDRNLRHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKVSAQMA

SEQ ID NO: 830716 - protein, 263 aa, Homo sapiens
VAAWWDMVDRNLRHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDENVKFLSSPLLILHGEDDRTVPLEYGKKLYEIARNAYRNKERVKMVIFPPGFQHNLLCKSPTLLITVRDFLSKQWS

SEQ ID NO: 830717 - protein, 67 aa, Homo sapiens
GQGRGVDVKTLGTSSVKTGQPSPSAGASVSPHHSALVQRFPAIDTYQRHKAEEEQMCHVISHNRKSA

SEQ ID NO: 830718 - protein, 1078 aa, Homo sapiens
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQDFFVNSNSKQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 830719 - protein, 539 aa, Homo sapiens
MAPRKRGGRGISFIFCCFRNNDHPEITYRLRNDSNFALQTMEPALPMPPVEELDVMFSELVKSIPQPTNALKSFNWSKLPENKLEGTVWTEIDDTKVFKILDLEDLERTFSAYQRQQDFFVNSNSKQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 830720 - protein, 1068 aa, Homo sapiens
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 830721 - protein, 238 aa, Homo sapiens
RLAFCSLLVPLRNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 830722 - protein, 1078 aa, Homo sapiens; identical to SEQ ID NO: 830718

SEQ ID NO: 830723 - protein, 1078 aa, Homo sapiens; identical to SEQ ID NO: 830718

SEQ ID NO: 830724 - protein, 1080 aa, Homo sapiens
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMSSLAFLINFFKLCQKPNKKRKYEKEN

SEQ ID NO: 830725 - protein, 1078 aa, Homo sapiens; identical to SEQ ID NO: 830718

SEQ ID NO: 830726 - protein, 1044 aa, Homo sapiens
MAPRKRGGRGISFIFCCFRNNDHPEITYRLRNDSNFALQTMEPALPMPPVEELDVMFSELVDELDLTDKHREAMFALPAEKKWQIYCSKKKRKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 830727 - protein, 190 aa, Homo sapiens [sequence omitted]

SEQ ID NO: 830728 - protein, 402 aa, Homo sapiens
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPCKCVRDSHVCF

SEQ ID NO: 830729 - protein, 345 aa, Homo sapiens
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVIERNGRKLKLFYGMSSDTAMNKHAGGVAEYRASEGKTVEVPYKGDVENTILDILGGLRSTCTYVGAAKLKELSRRATFIRVTQQHNTVFS

SEQ ID NO: 830730 - protein, 122 aa, Homo sapiens
MTSILEAVPQVKFICLDVANGYSEHFVEFVKLVRAKFPEHTIMAGNVVTGEMVEELILPSKLKLRTHSQSHHNPLSRTSNSTPTNSLMTSSKPRYLALPPTINLLGELSVLVHVLLIYHSPL

SEQ ID NO: 830731 - protein, 299 aa, Homo sapiens
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGDVENTILDILGGLRSTCTYVGAAKLKELSRRATFIRVTQQHNTVFS

SEQ ID NO: 830732 - protein, 346 aa, Homo sapiens
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVIERNGRKLKLFYGMSSDTAMNGGMLCPLFCLLLPGGFGALPPAFSGPRRKAPIGPTSEPCCPELITSLFKPTLAPFSFSLSLSLSLFFFLF

SEQ ID NO: 830733 - protein, 211 aa, Homo sapiens
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMEERIKNCSSWAQWLTTVIPALWEAEAGGSPEVRNLRPAWPTWRNRVSTKNTKISQP

SEQ ID NO: 830734 - protein, 345 aa, Homo sapiens; identical to SEQ ID NO: 830729

SEQ ID NO: 830735 - protein, 195 aa, Homo sapiens
MGLGSERCNIEGSTLDQTTTAVVGELGPVGLLGAVVGLNPQSLGHLGGGDSLAELPLMMSCPCFFLCEDGGCTCPGDVAKAFGAGADFVMLGGMFSGHTECAGEVIERNGRKLKLFYGMSSDTAMNKHAGGVAEYRASEGKTVEVPYKGDVENTILDILGGLRSTCTYVGAAKLKELSRRATFIRVTQQHNTVFS

SEQ ID NO: 830736 - protein, 317 aa, Homo sapiens
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVIERNGRKLKLLPPAFSGPRRKAPIGPTSEPCCPELITSLFKPTLAPFSFSLSLSLSLFFFLF

SEQ ID NO: 830737 - protein, 569 aa, Homo sapiens
LEVESGGSEGSGPVQVPEGILPPSEPSFFSSLFRRYPEIRSPASKERIRMSQDNDTLMRDILGHELAAMRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYVLRPALPGTMMQCYLTRDKHGVDKGLFPLYYLYLETSDSLQRFLLAGRKRRRSKTSNYLISLDPTHLSRDGDNFVGKVRSNVFSTKFTIFDNGVNPDREHLTRNTARIRQELGAVCYEPNVLGYLGPRKMTVILPGTNSQNQRINVQPLNEQESLLSRYQRGDKQGLLLLHNKTPSWDKENGVYTLNFHGRVTRASVKNFQIVDPKHQEHLVLQFGRVGPDTFTMDFCFPFSPLQAFSICLSSFN

SEQ ID NO: 830738 - protein, 536 aa, Homo sapiens
LEVESGGSEGSGPVQVPEGILPPSEPSFFSSLFRRYPEIRSPASKERIRMSQDNDTLMRDILGHELAAMRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYVLRPALPGTMMQCYLTRDKHGVDKGLFPLYYLYLETSDSLQRFLLAGRKRRRSKTSNYLISLDPTHLSRDGDNFVGKVRSNVFSTKFTIFDNGVNPDREHLTRNTARIRQELGAVCYEQESLLSRYQRGDKQGLLLLHNKTPSWDKENGVYTLNFHGRVTRASVKNFQIVDPKHQEHLVLQFGRVGPDTFTMDFCFPFSPLQAFSICLSSFN

SEQ ID NO: 830739 - protein, 530 aa, Homo sapiens
GLSWATEVPCALSPWACVSLSILGHELAAMRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYVLRPALPGTMMQCYLTRDKHGVDKGLFPLYYLYLETSDSLQRFLLAGRKRRRSKTSNYLISLDPTHLSRDGDNFVGKVRSNVFSTKFTIFDNGVNPDREHLTRNTARIRQELGAVCYEPNVLGYLGPRKMTVILPGTNSQNQRINVQPLNEQESLLSRYQRGDKQGLLLLHNKTPSWDKENGVYTLNFHGRVTRASVKNFQIVDPKHQEHLVLQFGRVGPDTFTMDFCFPFSPLQAFSICLSSFN

SEQ ID NO: 830740 - protein, 580 aa, Homo sapiens
LEVESGGSEGSGPVQVPEGILPPSEPSFFSSLFRRYPEIRSPASKERIRMSQDNDTLMRDILGHELAAMRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYVLRPALPGTMMQCYLTRDKHGVDKGLFPLYYLYLETSDSLQRFLLAGRKRRRSKTSNYLISLDPTHLSRDGDNFVGKVRSNVFSTKFTIFDNGVNPDREHLTRNTARIRQELGAVCYEPNVLGYLGPRKMTVILPGTNSQNQRINVQPLNEQESLLSRYQRGDKQGLLLLHNKTPSWDKENGVYTLNFHGRVTRASVKNFQIVDPKHRELLETSLAGPEEHLVLQFGRVGPDTFTMDFCFPFSPLQAFSICLSSFN

SEQ ID NO: 830741 - protein, 547 aa, Homo sapiens
GTRKETTTGKEALHKTRMSLKWTSVFLLIQLSCYFSSGSCGKVLVWPTEYSHWINMKTILEELVQRGHEVTVLTSSASTLVNASKSSAIKLEVYPTSLTKNDLEDSLLKILDRWIYGVSKNTFWSYFSQLQELCWEYYDYSNKLCKDAVLNKKLMMKLQESKFDVILADALNPCGELLAELFNIPFLYSLRFSVGYTFEKNGGGFLFPPSYVPVVMSELSDQMIFMERIKNMIHMLYFDFWFQIYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPVYKENIMKLSRIHHDQPVKPLDRAVFWIEFVMRHKGAKHLRVAAHNLTWIQYHSLDVIAFLLACVATMIFMITKCCLFCFRKLAKTGKKKKRD

SEQ ID NO: 830742 - protein, 547 aa, Homo sapiens; identical to SEQ ID NO: 830741

SEQ ID NO: 830743 - protein, 105 aa, Homo sapiens
MSLTDSLNNHRYSYKENIMKLSRIHHDQPVKPLDRAVFWIEFVMRHKGAKHLRVAAHNLTWIQYHSLDVIAFLLACVATMIFMITKCCLFCFRKLAKTGKKKKRD

SEQ ID NO: 830744 - protein, 223 aa, Homo sapiens
GTEAVAGRSWASGLRRSGRVSSAQWRHRCFTRCLSGDAAASSSAVKTLGASRTGFYLNEDKNLGRARLLTPVIPALWEAEVGGSPEVRSSRPAWPTCETSSLLKIQKLARRGGRISNMRALENDFFNSPPRKTVRFGGTVTEVLLKYKKGETNDFELLKNQLLDPDIKDDQIINWLLEFRSSVMYLTKDFEQLISIILRLPWLNRSQTVVEEYLAFLGNLVSA

SEQ ID NO: 830745 - protein, 106 aa, Homo sapiens
MRALENDFFNSPPRKTVRFGGTVTEVLLKYKKGETNDFELLKNQLLDPDIKDDQIINWLLEFRSSVMYLTKDFEQLISIILRLPWLNRSQTVVEEYLAFLGNLVSA

SEQ ID NO: 830746 - protein, 106 aa, Homo sapiens; identical to SEQ ID NO: 830745

SEQ ID NO: 830747 - protein, 106 aa, Homo sapiens; identical to SEQ ID NO: 830745

SEQ ID NO: 830748 - protein, 72 aa, Homo sapiens
GTEAVAGRSWASGRGAAVALVRPNGGTAASHVVCREMRPLRPLQSRRWARRGLGKIQAASFCASGTKAQDRA

SEQ ID NO: 830749 - protein, 72 aa, Homo sapiens; identical to SEQ ID NO: 830748

SEQ ID NO: 830750 - protein, 72 aa, Homo sapiens; identical to SEQ ID NO: 830748

SEQ ID NO: 830751 - protein, 72 aa, Homo sapiens; identical to SEQ ID NO: 830748

SEQ ID NO: 830752 - protein, 147 aa, Homo sapiens
LPAAGPAGLPPLRTSPCSGVTFAGRPRLGQESGQGVAARRRRALPRHPPLASERGPRTHTPAPLWQACLVGWVKPQCVHTERRGAVERGSGLAEEDADQAPATQGNSELPRAALRVSEENRGDGRNMGEGGLFPVHTHMHAATGRDS

SEQ ID NO: 830753 - protein, 83 aa, Homo sapiens
VGGLGAVTVSHPGVHTERRGAVERGSGLAEEDADQAPATQGNSELPRAALRVSEENRGDGRNMGEGGLFPVHTHMHAATGRDS

SEQ ID NO: 830754 - protein, 147 aa, Homo sapiens; identical to SEQ ID NO: 830752

SEQ ID NO: 830755 - protein, 89 aa, Homo sapiens
LPAAGPAGLPPLRTSPCSGVHTERRGAVERGSGLAEEDADQAPATQGNSELPRAALRVSEENRGDGRNMGEGGLFPVHTHMHAATGRDS

SEQ ID NO: 830756 - protein, 462 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEVSRNVNGVQGLNIFEHCYYCH

SEQ ID NO: 830757 - protein, 1377 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 830758 - protein, 1377 aa, Homo sapiens; identical to SEQ ID NO: 830757

SEQ ID NO: 830759 - protein, 1282 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEGLFHFYFLR

SEQ ID NO: 830760 - protein, 1335 aa, Homo sapiens
WYGRKSFGWSFRGAAARTGTKNRLQPCLVHPWQKVRRKTPPLFFGMDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 830761 - protein, 383 aa, Homo sapiens [sequence omitted]

SEQ ID NO: 830762 - protein, 124 aa, Homo sapiens
MENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 830763 - protein, 1274 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEG

SEQ ID NO: 830764 - protein, 1305 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEVEINYTGQMSVKCLNALSVTDLNKGGCFICQC

SEQ ID NO: 830765 - protein, 1154 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEKFA

SEQ ID NO: 830766 - protein, 974 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSELH

SEQ ID NO: 830767 - protein, 252 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDPRIRIMMSCRFSILKNVSCHIHSTRIKRSYSILVCEVKDGVYV

SEQ ID NO: 830768 - protein, 159 aa, Homo sapiens
QICTFSFLGLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGKNYYTNRILQRLELNERGPLES

SEQ ID NO: 830769 - protein, 1377 aa, Homo sapiens; identical to SEQ ID NO: 830757

SEQ ID NO: 830770 - protein, 757 aa, Homo sapiens
MQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 830771 - protein, 1290 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 830772 - protein, 893 aa, Homo sapiens
MTEFCNHSEDQNNLHLKKYGKLTTCTGCRTQCRFFDMTQCIGPNGYMEPYCSTACMNSHKTKYAKSQSLGIICHFCKRNSLPQYQATMPDGKLYNFCNSSCVAKFQGITQRFKPVHKAMLHELIHANNSALFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 830773 - protein, 693 aa, Homo sapiens
LSLDVSPATCDLLGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 830774 - protein, 1377 aa, Homo sapiens; identical to SEQ ID NO: 830757

SEQ ID NO: 830775 - protein, 1057 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKVHSLNSLYNNISL

SEQ ID NO: 830776 - protein, 804 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKASNSFITAATLTSLKKRCSCYHYKSGNSFILKMYTLKAQP

SEQ ID NO: 830777 - protein, 115 aa, Homo sapiens
MQPLAVKVSFQMLTRVFPEPTCSVSISLVPLALTFQILGSHKTSEQAVGFLLQLLGFVTRVLGLLGQPPAVPRGCLRHRWMPCVGREDCEHLQWDQLPQPGREAQALFHPGLWWG

SEQ ID NO: 830778 - protein, 416 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 830779 - protein, 266 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 830780 - protein, 386 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 830781 - protein, 144 aa, Homo sapiens
KSLGFPPRLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 830782 - protein, 316 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQPSTLQVPRGLPTATEEEFPLWVGAKTDSWNNLQMENQLVPGLGTASPRTIINPYEHNWCSEKRTSTGIITDGQTSP

SEQ ID NO: 830783 - protein, 65 aa, Homo sapiens
MPGGDPATPCARGQTPFSSRLSRLSSRERGESPGLRGSLCWQAYILSMEPCGHCLIINNVNFCRE

SEQ ID NO: 830784 - protein, 266 aa, Homo sapiens; identical to SEQ ID NO: 830779

SEQ ID NO: 830785 - protein, 266 aa, Homo sapiens; identical to SEQ ID NO: 830779

SEQ ID NO: 830786 - protein, 356 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGGFVSWRDPKSGSWYVETLDDIFEQWAHSEDLQSLLLRVANAVSVKGIYKQMPGCFNFLRKKLFFKTS

SEQ ID NO: 830787 - protein, 217 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKRGWLLDC

SEQ ID NO: 830788 - protein, 486 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 830789 - protein, 74 aa, Homo sapiens
YFAGNLASGGAAGATSLCFVYPLDFARTRLAADVGKSGTEREFRGLGDCLAAVTLASSLNLFRSSEPACQGQVP

SEQ ID NO: 830790 - protein, 94 aa, Homo sapiens
DFNTLLRLYQLFTSMWCFLNVKFAVSDFLPSSCPFDLPGPQYRLEKQSEPNVAVDLDSTLESQSAWEFCLVRENSTLAASLHARFVLYTRRVQA

SEQ ID NO: 830791 - protein, 522 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 830792 - protein, 522 aa, Homo sapiens; identical to SEQ ID NO: 830791

SEQ ID NO: 830793 - protein, 522 aa, Homo sapiens; identical to SEQ ID NO: 830791

SEQ ID NO: 830794 - protein, 330 aa, Homo sapiens
MTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 830795 - protein, 522 aa, Homo sapiens; identical to SEQ ID NO: 830791

SEQ ID NO: 830796 - protein, 544 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADETQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 830797 - protein, 374 aa, Homo sapiens
ARYEARCYFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 830798 - protein, 272 aa, Homo sapiens
GGGGEGRRGRETRAVHLTNEPIHKFGFSTLALVEKYSSPGLTSKESLFVRINAAHGFSLIQVDNTKVTMKEILLKAVKRRPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 830799 - protein, 146 aa, Homo sapiens [sequence omitted]

SEQ ID NO: 830800 - protein, 172 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKVSKNET

SEQ ID NO: 830801 - protein, 72 aa, Homo sapiens
PPPFPPPPPPPPPPPPPPPPPSPPPPPPPPPPPPPPPPPPPPPPPPPPPPPPPPPPPPPLPLPPPPPPPPPP

SEQ ID NO: 830802 - protein, 522 aa, Homo sapiens; identical to SEQ ID NO: 830791

SEQ ID NO: 830803 - protein, 494 aa, Homo sapiens
MAFLDNPTIILAHIRQSHVTSDDTGMCEMVLIDHDVDLEKIHPPSMPGDSGSEIQGSNAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 830804 - protein, 330 aa, Homo sapiens; identical to SEQ ID NO: 830794

SEQ ID NO: 830805 - protein, 359 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTANEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 830806 - protein, 323 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGACD

SEQ ID NO: 830807 - protein, 106 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQSSSPGVDA

SEQ ID NO: 830808 - protein, 533 aa, Homo sapiens
MAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNRWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 830809 - protein, 533 aa, Homo sapiens; identical to SEQ ID NO: 830808

SEQ ID NO: 830810 - protein, 599 aa, Homo sapiens
MAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNRWGRVGEVGQSKINHFTRLEDAKKDFEKKFREKTKNNWAERDHFVSHPGKYTLIEVQAEDEAQEAVVKVRWPRKVGRPWTEGGDSLESSRWLGSATAQLRSLSHRTPLWPQAGWSLSGVSPAPLLLPTCALYLQVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 830811 - protein, 599 aa, Homo sapiens
MAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNRWGRVGEVGQSKINHFTRLEDAKKDFEKKFREKTKNNWAERDHFVSHPGKYTLIEVQAEDEAQEAVVKVRWPRKVGRPWTEGGDSLESSRWLGSATAQLRSLSHRTPLWPQAGWSLSGVTPAPLLLPTCALYLQVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 830812 - protein, 436 aa, Homo sapiens
MAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNRWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTSLCPAQSSAAPHSPRASTSSTRRASVACATCWRSTSECPPCPPGSCKAGL

SEQ ID NO: 830813 - protein, 342 aa, Homo sapiens
TRGSTTRRRCAKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 830814 - protein, 146 aa, Homo sapiens
PFLAGAAKPEGITSQQRGAPQVSRRQAELPTGASLCLAVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 830815 - protein, 533 aa, Homo sapiens; identical to SEQ ID NO: 830808

SEQ ID NO: 830816 - protein, 562 aa, Homo sapiens
MAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNRWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLGEGGEAGRVAGASGWQGCGAESPHSPVPLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 830817 - protein, 533 aa, Homo sapiens; identical to SEQ ID NO: 830808

SEQ ID NO: 830818 - protein, 541 aa, Homo sapiens
RVASPHRLAPPSVAAASARWPCPPAAAAAARARRSRGPARSERGPVLPFARPRAPLFSAPPPPPCWVWSSSGAAAAAAGEGGRERSPPRPGAQGAGPPRSPASPRQPPSRPAVQPASQRASKQASTGPRPRLQLRPERARRRRARPQPAAEPTRGSAMAEQTYSWAYSLVDSSQVSTFLISILLIVYGSFRSLNMDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDVFWVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 830819 - protein, 347 aa, Homo sapiens
MDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDVFWVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 830820 - protein, 347 aa, Homo sapiens; identical to SEQ ID NO: 830819

SEQ ID NO: 830821 - protein, 541 aa, Homo sapiens; identical to SEQ ID NO: 830818

SEQ ID NO: 830822 - protein, 192 aa, Homo sapiens
RVASPHRLAPPSVAAASARWPCPPAAAAAARARRSRGPARSERGPVLPFARPRAPLFSAPPPPPCWVWSSSGAAAAAAGEGGRERSPPRPGAQGAGPPRSPASPRQPPSRPAVQPASQRASKQASTGPRPRLQLRPERARRRRARPQPAAEPTRGSAMAEQTYSWAYSLVDSSQVSTFLISILLIVYGSFSP

SEQ ID NO: 830823 - protein, 541 aa, Homo sapiens; identical to SEQ ID NO: 830818

SEQ ID NO: 830824 - protein, 347 aa, Homo sapiens; identical to SEQ ID NO: 830819

SEQ ID NO: 830825 - protein, 400 aa, Homo sapiens
VEQPPQLRGRRLALGQGAQGELVRAYSLVDSSQVSTFLISILLIVYGSFRSLNMDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDVFWVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 830826 - protein, 533 aa, Homo sapiens
RVASPHRLAPPSVAAASARWPCPPAAAAAARARRSRGPARSERGPVLPFARPRAPLFSAPPPPPCWVWSSSGAAAAAAGEGGRERSPPRPGAQGAGPPRSPASPRQPPSRPAVQPASQRASKQASTGPRPRLQLRPERARRRRARPQPAAEPTRGSAMAEQTYSWAYSLVDSSQVSTFLISILLIVYGSFRSLNMDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLLLSGLLIYDVFWVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 830827 - protein, 229 aa, Homo sapiens
QRFSQIIQSTKALQSQHSETLLLRARRADAESRLLPTPSVKGISPTRQVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 830828 - protein, 541 aa, Homo sapiens; identical to SEQ ID NO: 830818

SEQ ID NO: 830829 - protein, 541 aa, Homo sapiens; identical to SEQ ID NO: 830818

SEQ ID NO: 830830 - protein, 305 aa, Homo sapiens
QPARFSGLQPAPPPASPPPGAMAGCAARAPPGSEARLSLATFLLGASVLALPLLTRAGLQGRTGLALYVAGLNALLLLLYRPPRYQIAIRACFLGFVFGCGTLLSFSQSSWSHFGWYMCSLSLFHYSEYLVTAVNNPKSLSLDSFLLNHSLEYTVAALSSWLEFTLENIFWPELKQITWLSVTGLLMVVFGECLRKAAMFTAGSNFNHVVQNEKSDTHTLVTSGVYAWFRHPSYVGWFYWSIGTQVMLCNPICGVSYALTVWRFFRDRTEEEEISLIHFFGEEYLEYKKRVPTGLPFIKGVKVDL

SEQ ID NO: 830831 - protein, 305 aa, Homo sapiens; identical to SEQ ID NO: 830830

SEQ ID NO: 830832 - protein, 305 aa, Homo sapiens; identical to SEQ ID NO: 830830

SEQ ID NO: 830833 - protein, 305 aa, Homo sapiens; identical to SEQ ID NO: 830830

SEQ ID NO: 830834 - protein, 305 aa, Homo sapiens; identical to SEQ ID NO: 830830

SEQ ID NO: 830835 - protein, 119 aa, Homo sapiens [sequence omitted]

SEQ ID NO: 830836 - protein, 305 aa, Homo sapiens; identical to SEQ ID NO: 830830

SEQ ID NO: 830837 - protein, 305 aa, Homo sapiens; identical to SEQ ID NO: 830830

SEQ ID NO: 830838 - protein, 305 aa, Homo sapiens; identical to SEQ ID NO: 830830

SEQ ID NO: 830839 - protein, 305 aa, Homo sapiens; identical to SEQ ID NO: 830830

SEQ ID NO: 830840 - protein, 305 aa, Homo sapiens; identical to SEQ ID NO: 830830

SEQ ID NO: 830841 - protein, 305 aa, Homo sapiens; identical to SEQ ID NO: 830830

SEQ ID NO: 830842 - protein, 305 aa, Homo sapiens; identical to SEQ ID NO: 830830

SEQ ID NO: 830843 - protein, 305 aa, Homo sapiens; identical to SEQ ID NO: 830830

SEQ ID NO: 830844 - protein, 188 aa, Homo sapiens
MCSLSLFHYSEYLVTAVNNPKSLSLDSFLLNHSLEYTVAALSSWLEFTLENIFWPELKQITWLSVTGLLMVVFGECLRKAAMFTAGSNFNHVVQNEKSDTHTLVTSGVYAWFRHPSYVGWFYWSIGTQVMLCNPICGVSYALTVWRFFRDRTEEEEISLIHFFGEEYLEYKKRVPTGLPFIKGVKVDL

SEQ ID NO: 830845 - protein, 119 aa, Homo sapiens [sequence omitted]

SEQ ID NO: 830846 - protein, 287 aa, Homo sapiens
QPARFSGLQPAPPPASPPPGAMAGCAARAPPGSEARLSLATFLLGASVLALPLLTRAGLQGRTGLALYVAGLNALLLLLYRPPRYQIAIRACFLGFVFGCGTLLSFSQSSWSHFGWYMCSLSLFHYSEYLVTAVNNPKSLSLDSFLLNHSLEYTVAALSSWLEFTLENIFWPELKQITWLSVTGLLMVVFGECLRKAAMFTAGSNFNHVVQNDPSYVGWFYWSIGTQVMLCNPICGVSYALTVWRFFRDRTEEEEISLIHFFGEEYLEYKKRVPTGLPFIKGVKVDL

SEQ ID NO: 830847 - protein, 305 aa, Homo sapiens; identical to SEQ ID NO: 830830

SEQ ID NO: 830848 - protein, 305 aa, Homo sapiens; identical to SEQ ID NO: 830830

SEQ ID NO: 830849 - protein, 305 aa, Homo sapiens; identical to SEQ ID NO: 830830

SEQ ID NO: 830850 - protein, 127 aa, Homo sapiens
METWSGPARAQGYALMCVLMWLESEGVRKGPSGSCLRSCRLTFGGAEKAAWKSDLGTSLGIIRAHSEDRTEQDQRVVWFGVSAVGGGDGRQETDFGLDSYKELVMGSKAFQQRDIPSGCEVACCGRA

SEQ ID NO: 830851 - protein, 401 aa, Homo sapiens
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLENFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 830852 - protein, 264 aa, Homo sapiens
DAWATTRPDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 830853 - protein, 196 aa, Homo sapiens
GDPINGNRRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 830854 - protein, 419 aa, Homo sapiens
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 830855 - protein, 419 aa, Homo sapiens; identical to SEQ ID NO: 830854

SEQ ID NO: 830856 - protein, 384 aa, Homo sapiens
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTR

SEQ ID NO: 830857 - protein, 262 aa, Homo sapiens
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRMGSSLREQEKSTLQ

SEQ ID NO: 830858 - protein, 285 aa, Homo sapiens
AGTGRRFMDPEPGPRAAAAAGGTMSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRMGSSLREQEKSTLQ

SEQ ID NO: 830859 - protein, 127 aa, Homo sapiens; identical to SEQ ID NO: 830850

SEQ ID NO: 830860 - protein, 276 aa, Homo sapiens
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYSGISPLPQDGELTPRTGEINIAVTKEWFIIASFGLLSALTLCYMIIRATASLNANEVEWF

SEQ ID NO: 830861 - protein, 127 aa, Homo sapiens; identical to SEQ ID NO: 830850

SEQ ID NO: 830862 - protein, 419 aa, Homo sapiens; identical to SEQ ID NO: 830854

SEQ ID NO: 830863 - protein, 419 aa, Homo sapiens; identical to SEQ ID NO: 830854

SEQ ID NO: 830864 - protein, 406 aa, Homo sapiens
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFATSGPIRYPIKILE

SEQ ID NO: 830865 - protein, 262 aa, Homo sapiens; identical to SEQ ID NO: 830857

SEQ ID NO: 830866 - protein, 251 aa, Homo sapiens [sequence omitted]

SEQ ID NO: 830867 - protein, 141 aa, Homo sapiens
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 830868 - protein, 172 aa, Homo sapiens
SGWTPPPPLPPPLIQATSRQVSPEILAQRGVMGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 830869 - protein, 104 aa, Homo sapiens
LERPPTTTKFAAASPATLSEDEARLLLAALVQDYVQMKASELEQEQEREGSRIIAQKRACDTATCVTHRLAGLLSRSGGVVKNNFVPTNVGSKAFGRRRRDLQA

SEQ ID NO: 830870 - protein, 139 aa, Homo sapiens
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRNHCPEESL

SEQ ID NO: 830871 - protein, 117 aa, Homo sapiens
LERPPTTTKFAAASPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 830872 - protein, 120 aa, Homo sapiens
MMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 830873 - protein, 120 aa, Homo sapiens; identical to SEQ ID NO: 830872

SEQ ID NO: 830874 - protein, 120 aa, Homo sapiens; identical to SEQ ID NO: 830872

SEQ ID NO: 830875 - protein, 183 aa, Homo sapiens
MQPWALPTVGELWVCGRPGAALRWSLVLSPRLEPSGVISAHCNLHLLASSDSSASASRLCQRVMMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 830876 - protein, 120 aa, Homo sapiens; identical to SEQ ID NO: 830872

SEQ ID NO: 830877 - protein, 134 aa, Homo sapiens
GRPRRTDQKLCQRVMMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 830878 - protein, 120 aa, Homo sapiens; identical to SEQ ID NO: 830872

SEQ ID NO: 830879 - protein, 115 aa, Homo sapiens
LLRSLIRGFLKLKVNVAIVCAGEPGIFHFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 830880 - protein, 120 aa, Homo sapiens; identical to SEQ ID NO: 830872

SEQ ID NO: 830881 - protein, 120 aa, Homo sapiens; identical to SEQ ID NO: 830872

SEQ ID NO: 830882 - protein, 120 aa, Homo sapiens; identical to SEQ ID NO: 830872

SEQ ID NO: 830883 - protein, 120 aa, Homo sapiens; identical to SEQ ID NO: 830872

SEQ ID NO: 830884 - protein, 81 aa, Homo sapiens
GGVLPSSSWDIARVRSTPSQPLLWSPVGRGAAILVARGVSRIRRVSLPSRWRGLCPCSVTAALGKRSAPKTLWLQLRLPIL

SEQ ID NO: 830885 - protein, 120 aa, Homo sapiens; identical to SEQ ID NO: 830872

SEQ ID NO: 830886 - protein, 120 aa, Homo sapiens; identical to SEQ ID NO: 830872

SEQ ID NO: 830887 - protein, 247 aa, Homo sapiens
IRGLATGVVAVAVWTSGSIRDEVLMLVTGIDGVSRNLLLSRLMSRVRDRVSSDQKFNAAESFSVVAYCALMRHRLLPSFPSKHRFRYLVIITDLMITVSQVSFIFLFSMVTRFMHERVRRIILCQRVMMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 830888 - protein, 178 aa, Homo sapiens
MMPSRTNLATGIPSSKVKYSRLSSTDDGYIDLQGKCRRELTRLTGCVSVKLQEDLPDGDFANCPWGLEGATRRKLSSETLSAIIAEEGRGRFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 830889 - protein, 150 aa, Homo sapiens
MQPWALPTVGELWVCGRPGAALRRKTFQMEILLTVLGDYEGATRRKLSSETLSAIIAEEGRGRFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 830890 - protein, 120 aa, Homo sapiens; identical to SEQ ID NO: 830872

SEQ ID NO: 830891 - protein, 183 aa, Homo sapiens; identical to SEQ ID NO: 830875

SEQ ID NO: 830892 - protein, 121 aa, Homo sapiens
CQNNYMNKHLHTRTPRHCFPPPTPSLPDVPDKTTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 830893 - protein, 376 aa, Homo sapiens
MQWTSLLLLAGLFSLSQAQYEDDPHWWFHYLRSQQSTYYDPYDPYPYETYEPYPYGVDEGPAYTYGSPSPPDPRDCPQECDCPPNFPTAMYCDNRNLKYLPFVPSRMKYVYFQNNQITSIQEGVFDNATGLLWIALHGNQITSDKVGRKVFSKLRHLERLYLDHNNLTRMPGPLPRSLRELHLDHNQISRVPNNALEGLENLTALYLQHNEIQEVGSSMRGLRSLILLDLSYNHLRKVPDGLPSALEQLYMEHNNVYTVPDSYFRGAPKLLYVRLSHNSLTNNGLASNTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 830894 - protein, 376 aa, Homo sapiens; identical to SEQ ID NO: 830893

SEQ ID NO: 830895 - protein, 376 aa, Homo sapiens; identical to SEQ ID NO: 830893

SEQ ID NO: 830896 - protein, 85 aa, Homo sapiens
MQWTSLLLLAGLFSLSQAQYEDDPHWWFHYLRSQQSTYYDPYDPYPYETYEPYPYGVDEGPAYTYGSPSPPDPRDCPQECDCPPN

SEQ ID NO: 830897 - protein, 376 aa, Homo sapiens; identical to SEQ ID NO: 830893

SEQ ID NO: 830898 - protein, 376 aa, Homo sapiens; identical to SEQ ID NO: 830893

SEQ ID NO: 830899 - protein, 376 aa, Homo sapiens; identical to SEQ ID NO: 830893

SEQ ID NO: 830900 - protein, 376 aa, Homo sapiens; identical to SEQ ID NO: 830893

SEQ ID NO: 830901 - protein, 311 aa, Homo sapiens
MSKSESPKEPKQLRKLFIGGLSFETTNESLRSHFEQWGTLMDCVVMRDPNTKCSRGFGFVTYATVEEVDAAMNARPHKVDGRVVESKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKHETRWLWRFQQQQ

SEQ ID NO: 830902 - protein, 223 aa, Homo sapiens
MATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 830903 - protein, 223 aa, Homo sapiens; identical to SEQ ID NO: 830902

SEQ ID NO: 830904 - protein, 223 aa, Homo sapiens; identical to SEQ ID NO: 830902

SEQ ID NO: 830905 - protein, 83 aa, Homo sapiens
PEVAHSPSSNNSFPRARRAPGSRGEAEANGEAFRVGLLRWWRQRLPPACEELAERGLGAGGEGGALGRCTTEIRVRASSGRPR

SEQ ID NO: 830906 - protein, 223 aa, Homo sapiens; identical to SEQ ID NO: 830902

SEQ ID NO: 830907 - protein, 223 aa, Homo sapiens; identical to SEQ ID NO: 830902

SEQ ID NO: 830908 - protein, 223 aa, Homo sapiens; identical to SEQ ID NO: 830902

SEQ ID NO: 830909 - protein, 622 aa, Homo sapiens
QPPVHTLRVFVSCQAPWSHPPAQLSPVGADAMTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 830910 - protein, 699 aa, Homo sapiens
QPPVHTLRVFVSCQAPWSHPPAQLSPVGADAMTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARSPHDEDPQAVTYAPVKHSRPRREMASPPSPLSGEFLDTKDRQAEEDRQMDTERVLSSPGPQASPPPPRSFLSLSPVQAAASEAPQDVTYAQLHSLTLRREATEPPPSQEREPPAEPSIYAPLAIH

SEQ ID NO: 830911 - protein, 468 aa, Homo sapiens
WYGPNVSYDQDLLEIPGPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARSPHDEDPQAVTYAPVKHSRPRREMASPPSPLSGEFLDTKDRQAEEDRQMDTERVLSSPGPQASPPPPRSFLSLSPVQAAASEAPQDVTYAQLHSLTLRREATEPPPSQEREPPAEPSIYAPLAIH

SEQ ID NO: 830912 - protein, 599 aa, Homo sapiens
QPPVHTLRVFVSCQAPWSHPPAQLSPVGADAMTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARSPHDEDPQAVTYAPVKHSRPRREMASPPSPLSGEFLDTKDRQAEEDRQMDTERVLSSPGPQASPPPPRSFLSLSPVQAAASEAPQDVTYAQLHSLTLRREATEPPPSQEREPPAEPSIYAPLAIH

SEQ ID NO: 830913 - protein, 168 aa, Homo sapiens
MKERPSSRLHTEGAHINDVIPIPNVITLQGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 830914 - protein, 321 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVRGPNNYYSMAQR

SEQ ID NO: 830915 - protein, 239 aa, Homo sapiens
KNYGWVRRSVCNRPRNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSIPQEDPLDR

SEQ ID NO: 830916 - protein, 168 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTTTVLLSQQQKPEDTTIPSTELAKQVIEYARQLEMIV

SEQ ID NO: 830917 - protein, 364 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830918 - protein, 364 aa, Homo sapiens; identical to SEQ ID NO: 830917

SEQ ID NO: 830919 - protein, 280 aa, Homo sapiens
DLEDPIRDGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830920 - protein, 197 aa, Homo sapiens
MAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830921 - protein, 346 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830922 - protein, 346 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHELFKTVTLQGFAQ

SEQ ID NO: 830923 - protein, 213 aa, Homo sapiens
YYYYIRGRSIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830924 - protein, 177 aa, Homo sapiens
MHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830925 - protein, 326 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSIPQEDPLDR

SEQ ID NO: 830926 - protein, 297 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTISELGLVMGLWITALISPPLAVDMCGHVCQT

SEQ ID NO: 830927 - protein, 318 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWYPGGIPTLDI

SEQ ID NO: 830928 - protein, 297 aa, Homo sapiens; identical to SEQ ID NO: 830926

SEQ ID NO: 830929 - protein, 163 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARECHWGWLGVIIWGSWQEW

SEQ ID NO: 830930 - protein, 72 aa, Homo sapiens
EVIQRIRPDYAKKRGWVLGPNNYYSFAQPAAEAGRHHHSLHRTGQTGHRVCPAAGDDRLSPPGTGWGRARVI

SEQ ID NO: 830931 - protein, 364 aa, Homo sapiens; identical to SEQ ID NO: 830917

SEQ ID NO: 830932 - protein, 279 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRCVAGPGPVEFG

SEQ ID NO: 830933 - protein, 108 aa, Homo sapiens
MPLPGCFSIASASAEQYLMEGSYNKVFLAKGNIPAESYTFFIDILLDTIRDEIAGCIEKAYEKILFTEATRILFFNTPKKMTDYAKKRGWVLGPNNYYSMAQRWGPSR

SEQ ID NO: 830934 - protein, 364 aa, Homo sapiens; identical to SEQ ID NO: 830917

SEQ ID NO: 830935 - protein, 197 aa, Homo sapiens; identical to SEQ ID NO: 830920

SEQ ID NO: 830936 - protein, 265 aa, Homo sapiens
KLVRGLGCKSAEGGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830937 - protein, 314 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830938 - protein, 207 aa, Homo sapiens
LPTGMSQSVDKSHKTLCIILRRTGRIYVTSEAVLRFLLCSSFRKGESTTYSEHLYVVVPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830939 - protein, 326 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSMAQRWGPSR

SEQ ID NO: 830940 - protein, 105 aa, Homo sapiens
MRSFSSSPRDEIAGCIEKAYEKILFTEATRILFFNTPKKMTDYAKKRGWVLGPNNYYSFAQPAAEAGRHHHSLHRTGQTGHRVCPAAGDDRLSPPGTGWGRARVI

SEQ ID NO: 830941 - protein, 269 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKQSQARKQAVIVERITHVDHLNIDRTAAAYTFLLEVQHYASHR

SEQ ID NO: 830942 - protein, 268 aa, Homo sapiens
HFRDTMKGGFTGGDEYQKHFLPRDYLATYYSFDGSPSPEAEMLKFNLECLHKTFGPGGLQGDTLIDIGSGPTIYQVLAACDSFQDITLSDFTDRNREELEKWLKKEPGAYDWTPAVKFACELEGNSGRWEEKEEKLRAAVKRVLKCDVHLGNPLAPAVLPLADCVLTLLAMECACCSLDAYRAALCNLASLLKPGGHLVTTVTLRLPSYMVGKREFSCVALEKEEVEQAVLDAGFDIEQLLHSPQSYSVTNAANNGVCCIVARKKPGP

SEQ ID NO: 830943 - protein, 268 aa, Homo sapiens; identical to SEQ ID NO: 830942

SEQ ID NO: 830944 - protein, 268 aa, Homo sapiens; identical to SEQ ID NO: 830942

SEQ ID NO: 830945 - protein, 422 aa, Homo sapiens
MVSESHHEALAAPPVTTVATVLPSNATEPASPGEGKEDAFSKLKEKFMNELHKIPLPPWALIAIAIVAVLLVLTCCFCICKKCLFKKKNKKKGKEKGGKNAINMKDVKDLGKTMKDQALKDDDAETGLTDGEEKEEPKEEEKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKEEQEKLGDICFSLRYVPTAGKLTVVILEAKNLKKMDVGGLSDPYVKIHLMQNGKRLKKKKTTIKKNTLNPYYNESFSFEVPFEQIQKVQVVVTVLDYDKIGKNDAIGKVFVGYNSTGAELRHWSDMLANPRRPIAQWHTLQVEEEVDAMLAVKK

SEQ ID NO: 830946 - protein, 422 aa, Homo sapiens; identical to SEQ ID NO: 830945

SEQ ID NO: 830947 - protein, 422 aa, Homo sapiens; identical to SEQ ID NO: 830945

SEQ ID NO: 830948 - protein, 73 aa, Homo sapiens
GRLLTGGIPGEAAVWGCSRPSTAPSVFPPPPAAAAAAAAVSSGNLRLHPGQVPRVVLSREGGLAPRRGVCRVG

SEQ ID NO: 830949 - protein, 422 aa, Homo sapiens; identical to SEQ ID NO: 830945

SEQ ID NO: 830950 - protein, 663 aa, Homo sapiens
MAITLQPSDLIFEFASNGMDDDIHQLEDPSVFPAVIVEQVPYPDLLHLYSGLELDDVHNGIITDGTLCMTQDQILEGSFLLTDDNEATSHTMSTAEVLLNMESPSDILDEKQIFSTSEMLPDSDPAPAVTLPNYLFPASEPDALNRAGDTSDQEGHSLEEKASREESAKKTGKSKKRIRKTKGNRSTSPVTDPSIPIRKKSKDGKGSTIYLWEFLLALLQDRNTCPKYIKWTQREKGIFKLVDSKAVSKLWGKQKNKPDMNYETMGRALRYYYQRGILAKVEGQRLVYQFKEMPKDLVVIEDEDESSEATAAPPQASTASVASASTTRRTSSRVSSRSAPQGKGSSSWEKPKIQHVGLQPSASLELGPSLDEEIPTTSTMLVSPAEGQVKLTKAVSASSVPSNIHLGVAPVGSGSALTLQTIPLTTVLTNGPPASTTAPTQLVLQSVPAASTFKDTFTLQASFPLNASFQDSQVAAPGAPLILSGLPQLLAGANRPTNPAPPTVTGAGPAGPSSQPPGTVIAAFIRTSGTTAAPRVKEGPLRSSSYVQGMVTGAPMEGLLVPEETLRELLRDQAHLQPLPTQVVSRGSHNPSLLGNQTLSPPSRPTVGLTPVAELELSSGSGSLLMAEPSVTTSGSLLTRSPTPAPFSPFNPTSLIKMEPHDI

SEQ ID NO: 830951 - protein, 645 aa, Homo sapiens
MDDDIHQLEDPSVFPAVIVEQVPYPDLLHLYSGLELDDVHNGIITDGTLCMTQDQILEGSFLLTDDNEATSHTMSTAEVLLNMESPSDILDEKQIFSTSEMLPDSDPAPAVTLPNYLFPASEPDALNRAGDTSDQEGHSLEEKASREESAKKTGKSKKRIRKTKGNRSTSPVTDPSIPIRKKSKDGKGSTIYLWEFLLALLQDRNTCPKYIKWTQREKGIFKLVDSKAVSKLWGKQKNKPDMNYETMGRALRYYYQRGILAKVEGQRLVYQFKEMPKDLVVIEDEDESSEATAAPPQASTASVASASTTRRTSSRVSSRSAPQGKGSSSWEKPKIQHVGLQPSASLELGPSLDEEIPTTSTMLVSPAEGQVKLTKAVSASSVPSNIHLGVAPVGSGSALTLQTIPLTTVLTNGPPASTTAPTQLVLQSVPAASTFKDTFTLQASFPLNASFQDSQVAAPGAPLILSGLPQLLAGANRPTNPAPPTVTGAGPAGPSSQPPGTVIAAFIRTSGTTAAPRVKEGPLRSSSYVQGMVTGAPMEGLLVPEETLRELLRDQAHLQPLPTQVVSRGSHNPSLLGNQTLSPPSRPTVGLTPVAELELSSGSGSLLMAEPSVTTSGSLLTRSPTPAPFSPFNPTSLIKMEPHDI

SEQ ID NO: 830952 - protein, 645 aa, Homo sapiens; identical to SEQ ID NO: 830951

SEQ ID NO: 830953 - protein, 200 aa, Homo sapiens
MFLTYFLLLSWAVCVIPAPRQTIAFADTPAYFPDPGLPLDYFLTFSSCQASLRLVRQRPRWGPPPFLLKHGHLPHGFCCSACLQLTSKADQPASVMTAADLLGCTNAPHLPLSHLTLTPSPRRRESAARSSRGTSLSSWLPASPFPLSEEGSTYSLSKPTPRPIAWISSPLPSLNELASLLPSLRARLRNVSHGNNSIIW

SEQ ID NO: 830954 - protein, 663 aa, Homo sapiens; identical to SEQ ID NO: 830950

SEQ ID NO: 830955 - protein, 663 aa, Homo sapiens; identical to SEQ ID NO: 830950

SEQ ID NO: 830956 - protein, 281 aa, Homo sapiens
RSTGEMEVEGLPPSSRLLPTPCPSSSRYYYQRGILTLQTIPLTTVLTNGPPASTTAPTQLVLQSVPAASTFKDTFTLQASFPLNASFQDSQVAAPGAPLILSGLPQLLAGANRPTNPAPPTVTGAGPAGPSSQPPGTVIAAFIRTSGTTAAPRVKEGPLRSSSYVQGMVTGAPMEGLLVPEETLRELLRDQAHLQPLPTQVVSRGSHNPSLLGNQTLSPPSRPTVGLTPVAELELSSGSGSLLMAEPSVTTSGSLLTRSPTPAPFSPFNPTSLIKMEPHDI

SEQ ID NO: 830957 - protein, 128 aa, Homo sapiens
MPKGKYLSNKIRMAPSARGNKFGQRRLNINKGETPLWGHTIYLPIDRPLGEGMVVPLGNKWVPISRGLKKKLVASPGKNDSTGHQANSTETQQATRNNNRSSTKTRQPNVIRGGDITTQARRPATRRD

SEQ ID NO: 830958 - protein, 144 aa, Homo sapiens
GSVHFSHPRPALLILLSFLTSCHCQRFYRYRAESFPAISFNTQASQIFLTQDLLGKACWVSSTDFKLSLHQNLGECFEDMKLFLPPPVALGWPTPTVELEREGGVQTWNFNSVIQGFSYVQHPCHLMIPPLLFHLPEACFLMPA

SEQ ID NO: 830959 - protein, 194 aa, Homo sapiens
MGHSWPGPKAPPSILVLLKPKGPLAVTEKEVQQWYKGFIKDCPSGQLDAAGFQKIYKQFFPFGDPTKFATFVFNVFDENKDGRIEFSEFIQALSVTSRGTLDEKLRWAFKLYDLDNDGYITRNEMLDIVDAIYQMVGNTVELPEEENTPEKRVDRIFAMMDKNADGKLTLQEFQEGSKADPSIVQALSLYDGLV

SEQ ID NO: 830960 - protein, 213 aa, Homo sapiens
ARPRPGPPGPAAPAGRPNRVRPGGAGAAAAEDGEIQQQVEARSCGGADQEDLLYKGFIKDCPSGQLDAAGFQKIYKQFFPFGDPTKFATFVFNVFDENKDGRIEFSEFIQALSVTSRGTLDEKLRWAFKLYDLDNDGYITRNEMLDIVDAIYQMVGNTVELPEEENTPEKRVDRIFAMMDKNADGKLTLQEFQEGSKADPSIVQALSLYDGLV

SEQ ID NO: 830961 - protein, 221 aa, Homo sapiens
RGPGPARPAQPLLLGAPTGSGPGGRGPRPPRMGKSNSKLKPEVVEELTRKTYFTEKEVQQWYKGFIKDCPSGQLDAAGFQKIYKQFFPFGDPTKFATFVFNVFDENKDGRIEFSEFIQALSVTSRGTLDEKLRWAFKLYDLDNDGYITRNEMLDIVDAIYQMVGNTVELPEEENTPEKRVDRIFAMMDKNADGKLTLQEFQEGSKADPSIVQALSLYDGLV

SEQ ID NO: 830962 - protein, 221 aa, Homo sapiens; identical to SEQ ID NO: 830961

SEQ ID NO: 830963 - protein, 83 aa, Homo sapiens
RLGGGWVATGVASGLSRWYACGPQPSMPVGPQPEPAQSCRKGRPSRPWRGAGHWPFSLEFAWQGPISAPSSPQASGCSDAAES

SEQ ID NO: 830964 - protein, 221 aa, Homo sapiens; identical to SEQ ID NO: 830961

SEQ ID NO: 830965 - protein, 221 aa, Homo sapiens; identical to SEQ ID NO: 830961

SEQ ID NO: 830966 - protein, 221 aa, Homo sapiens; identical to SEQ ID NO: 830961

SEQ ID NO: 830967 - protein, 85 aa, Homo sapiens
CRRILSQVPPEQPVRLSTAALPPNAARFRCSDAEGMPIVPLQSLALGPGQAPAPGGQSATACPLPRSVCSSLCVDGDLGECSDFP

SEQ ID NO: 830968 - protein, 1272 aa, Homo sapiens [sequence omitted]

SEQ ID NO: 830969 - protein, 1264 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 830970 - protein, 1379 aa, Homo sapiens
MQQAPQPYEFFSEENSPKWRGLLVSALRKMESRFFARLGCSGAILAHCNLHLSGSSDSPASASRVAGTTGVCHHAQVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 830971 - protein, 1332 aa, Homo sapiens [sequence omitted]

SEQ ID NO: 830972 - protein, 1332 aa, Homo sapiens [sequence omitted]

SEQ ID NO: 830973 - protein, 167 aa, Homo sapiens [sequence omitted]

SEQ ID NO: 830974 - protein, 1332 aa, Homo sapiens [sequence omitted]

SEQ ID NO: 830975 - protein, 1332 aa, Homo sapiens [sequence omitted]

SEQ ID NO: 830976 - protein, 1332 aa, Homo sapiens [sequence omitted]

SEQ ID NO: 830977 - protein, 741 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGILYKGLIESYIEHEFMFKFV

SEQ ID NO: 830978 - protein, 1029 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFVSLL

SEQ ID NO: 830979 - protein, 741 aa, Homo sapiens; identical to SEQ ID NO: 830977

SEQ ID NO: 830980 - protein, 1332 aa, Homo sapiens [sequence omitted]

SEQ ID NO: 830981 - protein, 1319 aa, Homo sapiens
MVLFHCPLDVLLQHLWVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 830982 - protein, 1332 aa, Homo sapiens [sequence omitted]

SEQ ID NO: 830983 - protein, 1332 aa, Homo sapiens [sequence omitted]

SEQ ID NO: 830984 - protein, 1332 aa, Homo sapiens [sequence omitted]

SEQ ID NO: 830985 - protein, 1332 aa, Homo sapiens [sequence omitted]

SEQ ID NO: 830986 - protein, 1332 aa, Homo sapiens [sequence omitted]

SEQ ID NO: 830987 - protein, 1173 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKVINRTLLQLI

SEQ ID NO: 830988 - protein, 714 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRFGLNIFYIYIYTHIYTHTHTFYVSVFNI

SEQ ID NO: 830989 - protein, 235 aa, Homo sapiens
MENSGKANKKDTHDGPPKEIKLPTSEALLDYQCQIKEDAVEQFMFQIKTLRKKNQKYHERNSRLKEEQIWHIRHLLKELSEEKAEGLPVVTREDVEEAMKEKWKFERDQEKNLRDMRMQISNAEKLFLEKLSEKEYWEEYKNVGSERHAKLITSLQNDINTVKENAEKMSEHYKITLEDTRKKIIKETLLQLDQKKEWATQNAVKLIDKGSYLEIWENDWLKKERLQFTGRKLKN

SEQ ID NO: 830990 - protein, 262 aa, Homo sapiens
MAVTAQAARRKERVLCLFDVDGTLTPARQKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKRGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 830991 - protein, 262 aa, Homo sapiens; identical to SEQ ID NO: 830990

SEQ ID NO: 830992 - protein, 235 aa, Homo sapiens [sequence omitted]

SEQ ID NO: 830993 - protein, 267 aa, Homo sapiens
MPLPILCGEVALAWALEAFLQGWIREEDSRTGAKKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKRGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 830994 - protein, 269 aa, Homo sapiens
MAVTAQAARRKERVLCLFDVDGTLTPARQKIDPEVAAFLQKLRSRVQIGVVGGSDYCKIAEQLGDGDEVIEKFDYVFAENGTVQYKHGRLLSKQSPVFLGQTIQNHLGEELLQDLINFCLSYMALLRLPKKRGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 830995 - protein, 234 aa, Homo sapiens
MKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKRGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 830996 - protein, 157 aa, Homo sapiens
MCLPRTGRCSISTDDCSPSSGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 830997 - protein, 162 aa, Homo sapiens
MAVTAQAARRKERVLCLFDVDGTLTPARQSWSREGFFSNSFMSSTHPDVRGSRPSLFAVRTLRKVRKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKR

SEQ ID NO: 830998 - protein, 240 aa, Homo sapiens
MAVTAQAARRKERVLCLFDVDGTLTPARQKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKRGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPDTVQRCREIFFPETAHEA

SEQ ID NO: 830999 - protein, 244 aa, Homo sapiens
MAVTAQAARRKERVLCLFDVDGTLTPARQIGVVGGSDYCKIAEQLGDGDEVIEKFDYVFAENGTVQYKHGRLLSKQTIQNHLGEELLQDLINFCLSYMALLRLPKKRGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 831000 - protein, 262 aa, Homo sapiens; identical to SEQ ID NO: 830990

SEQ ID NO: 831001 - protein, 336 aa, Homo sapiens
MAVTAQAARRKERVLCLFDVDGTLTPARQKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKRLRSHQPGLQNLGPEGGEVWVPQREPGDTWAPDFLRGVWILVPFEVLEAGVPGGARFEFRAVLVLSGSPPSLTTSGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 831002 - protein, 128 aa, Homo sapiens
MLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 831003 - protein, 172 aa, Homo sapiens
MAVTAQAARRKERVLCLFDVDGTLTPARQKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKRGTFIEFRNGMLNISPIGRSCTLEERIEFSELDKKEKIREKFVEALEA

SEQ ID NO: 831004 - protein, 121 aa, Homo sapiens
MSSTHPDVRGSRPSLFAVRTLRNSEKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKR

SEQ ID NO: 831005 - protein, 962 aa, Homo sapiens
MNFLRGVMGGQSAGPQHTEAETIQKLCDRVASSTLLDDRRNAVRALKSLSKKYRLEVGIQAMEHLIHVLQTDRSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 831006 - protein, 900 aa, Homo sapiens
MIEEMLFVLSNHYLRNTAWKWVYKLWNILFMFYKQIEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 831007 - protein, 704 aa, Homo sapiens [sequence omitted]

SEQ ID NO: 831008 - protein, 962 aa, Homo sapiens; identical to SEQ ID NO: 831005

SEQ ID NO: 831009 - protein, 962 aa, Homo sapiens; identical to SEQ ID NO: 831005

SEQ ID NO: 831010 - protein, 962 aa, Homo sapiens; identical to SEQ ID NO: 831005

SEQ ID NO: 831011 - protein, 403 aa, Homo sapiens [sequence omitted]

SEQ ID NO: 831012 - protein, 322 aa, Homo sapiens
HASGPRVHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 831013 - protein, 239 aa, Homo sapiens [sequence omitted]

SEQ ID NO: 831014 - protein, 676 aa, Homo sapiens
MNFLRGVMGGQSAGPQHTEAETIQKLCDRVASSTLLDDRRNAVRALKSLSKKYRLEVGIQAMEHLIHVLQTDRSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTQVVLLILNPLTKHIAYPFLVLSL

SEQ ID NO: 831015 - protein, 427 aa, Homo sapiens
MNFLRGVMGGQSAGPQHTEAETIQKLCDRVASSTLLDDRRNAVRALKSLSKKYRLEVGIQAMEHLIHVLQTDRSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVRTARANNRHNLLHYVYRSLSVFSKFYWLLPSPELKLVSCFCY

SEQ ID NO: 831016 - protein, 962 aa, Homo sapiens; identical to SEQ ID NO: 831005

SEQ ID NO: 831017 - protein, 969 aa, Homo sapiens
MNFLRGVMGGQSAGPQHTEAETIQKLCDRVASSTLLDDRRNAVRALKSLSKKYRLEVGIQAMEHLIHVLQTDRSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGDKIDRRGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 831018 - protein, 962 aa, Homo sapiens; identical to SEQ ID NO: 831005

SEQ ID NO: 831019 - protein, 468 aa, Homo sapiens
EVDSVNLGRQQQTGFQEPVFDEARTEELTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 831020 - protein, 977 aa, Homo sapiens
MNFLRGVMGGQSAGPQHTEAETIQKLCDRVASSTLLDDRRNAVRALKSLSKKYRLEVGIQAMEHLIHVLQTDRSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVKRDELNWEHREVITKTGGLTSSKRSHIITTETNNYFGILLFIF

SEQ ID NO: 831021 - protein, 494 aa, Homo sapiens
MNFLRGVMGGQSAGPQHTEAETIQKLCDRVASSTLLDDRRNAVRALKSLSKKYRLEVGIQAMEHLIHVLQTDRSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDAQVIRSAAVYVGVVPRFLQLGALALSWVRMAPEHGPVLASWTPVFHGAFRAHTGVYGSRHRGVTSLERTSQSGFPVFFRLF

SEQ ID NO: 831022 - protein, 436 aa, Homo sapiens
MLDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 831023 - protein, 350 aa, Homo sapiens
MLDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKSWVQDHRAGDALV

SEQ ID NO: 831024 - protein, 398 aa, Homo sapiens
MLDPDSDQPLNSLVKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 831025 - protein, 493 aa, Homo sapiens
MLDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKDRTIQRSCNSPGTGLVIQQPAVPLMELRSARHTHRLTTCVCFLSFPALQPLSPLCPFPWD

SEQ ID NO: 831026 - protein, 397 aa, Homo sapiens
MLDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQVGPPRIMGSSKNRV

SEQ ID NO: 831027 - protein, 436 aa, Homo sapiens; identical to SEQ ID NO: 831022

SEQ ID NO: 831028 - protein, 336 aa, Homo sapiens
MLDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGG

SEQ ID NO: 831029 - protein, 197 aa, Homo sapiens
MLDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPVSQVLVSLHCLCCWES

SEQ ID NO: 831030 - protein, 385 aa, Homo sapiens
MLDPDSDQPLNSLDVKPLRKPRIPMETFRKVGIPIIIALLSLASIIIVVVLIRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 831031 - protein, 350 aa, Homo sapiens; identical to SEQ ID NO: 831023

SEQ ID NO: 831032 - protein, 133 aa, Homo sapiens
MLDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEP

SEQ ID NO: 831033 - protein, 790 aa, Homo sapiens
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEDNTASILTRRRRFSRTVQDVYYLPIMISDGGIPSLSSSSTLTIRVCACERDGRVRTCHAEAFLSSAGLSTGALIAILLCVLILLAIVVLFITLRRSKKEPLIISEEDVRENVVTYDDEGGGEEDTEAFDITALRNPSAAEELKYRRDIRPEVKLTPRHQTSSTLESIDVQEFIKQRLAEADLDPSVPPYDSLQTYAYEGQRSEAGSISSLDSATTQSDQDYHYLGDWGPEFKKLAELYGEIESERTT

SEQ ID NO: 831034 - protein, 790 aa, Homo sapiens; identical to SEQ ID NO: 831033

SEQ ID NO: 831035 - protein, 118 aa, Homo sapiens
GGLLLLLNSRPRRVGFTLTQNATNPDTERPFLCSATQPGSRPKSRHTKTDGHTLMTPEQVQTNMTLHTRNVVQLNTLIPRPGPLAHTRPLGTQALPNLFILSNDVFGSAHTRSHTHLL

SEQ ID NO: 831036 - protein, 90 aa, Homo sapiens
NLRLGTRLGGCDHDPSTMAVGKNKRLTKGGKKGAKKKVVDPFSKKDWYDVKAPAMFNYKKYWKDARHQDPRGTKIASDGLKGRVFERESC

SEQ ID NO: 831037 - protein, 101 aa, Homo sapiens
YCHTIVGRKTFIWNIQTYSSGCDHDPSTMAVGKNKRLTKGGKKGAKKKVVDPFSKKDWYDVKAPAMFNYKKYWKDARHQDPRGTKIASDGLKGRVFERESC

SEQ ID NO: 831038 - protein, 102 aa, Homo sapiens
MMSSLQHTHAHTHNCFEKEKAQSLLTLSGGTSSMGGFQWGAQGPGKFLGKKKATGGGPERTTGGPHTSFETRKPGIGEIYLKPTKLPRKILGSHTGSQNFSN

SEQ ID NO: 831039 - protein, 82 aa, Homo sapiens
AAYYYYCSEFKLLTMYGDMGAQGPGKFLGKKKATGGGPERTTGGPHTSFETRKPGIGEIYLKPTKLPRKILGSHTGSQNFPN

SEQ ID NO: 831040 - protein, 90 aa, Homo sapiens; identical to SEQ ID NO: 831036

SEQ ID NO: 831041 - protein, 114 aa, Homo sapiens
MVTCLRLFCVGFTLTQNATNPDTERPFLCSATQPGSRPKSRHTKTDGHTLMTPEQVQTNMTLHTRNVVQLNTLIPRPGPLAHTRPLGTQALPNLFILSNDVFGSAHTRSHTHLL

SEQ ID NO: 831042 - protein, 114 aa, Homo sapiens; identical to SEQ ID NO: 831041

SEQ ID NO: 831043 - protein, 114 aa, Homo sapiens; identical to SEQ ID NO: 831041

SEQ ID NO: 831044 - protein, 114 aa, Homo sapiens; identical to SEQ ID NO: 831041

SEQ ID NO: 831045 - protein, 114 aa, Homo sapiens; identical to SEQ ID NO: 831041

SEQ ID NO: 831046 - protein, 114 aa, Homo sapiens; identical to SEQ ID NO: 831041

SEQ ID NO: 831047 - protein, 114 aa, Homo sapiens; identical to SEQ ID NO: 831041

SEQ ID NO: 831048 - protein, 114 aa, Homo sapiens; identical to SEQ ID NO: 831041

SEQ ID NO: 831049 - protein, 114 aa, Homo sapiens; identical to SEQ ID NO: 831041

SEQ ID NO: 831050 - protein, 114 aa, Homo sapiens; identical to SEQ ID NO: 831041

SEQ ID NO: 831051 - protein, 92 aa, Homo sapiens
RLVRGRVLIGRGCDHDPSTMAVGKNKRLTKGGKKGAKKKVVDPFSKKDWYDVKAPAMFNYKKYWKDARHQDPRGTKIASDGLKGRVFERESC

SEQ ID NO: 831052 - protein, 114 aa, Homo sapiens; identical to SEQ ID NO: 831041

SEQ ID NO: 831053 - protein, 114 aa, Homo sapiens; identical to SEQ ID NO: 831041

SEQ ID NO: 831054 - protein, 114 aa, Homo sapiens; identical to SEQ ID NO: 831041

SEQ ID NO: 831055 - protein, 114 aa, Homo sapiens; identical to SEQ ID NO: 831041

SEQ ID NO: 831056 - protein, 114 aa, Homo sapiens; identical to SEQ ID NO: 831041

SEQ ID NO: 831057 - protein, 114 aa, Homo sapiens; identical to SEQ ID NO: 831041

SEQ ID NO: 831058 - protein, 108 aa, Homo sapiens
TASTRPGVNRPRPKFSRDSHFRPFGSLTAVTMTPAPWRLARTSALRKAAKREPRRKCKSRLSWRLAFWGSAGIGGLVLDRGVGRMARIPVGLCGPWRVGAPRNAAWRG

SEQ ID NO: 831059 - protein, 114 aa, Homo sapiens
MVTCLRLFCVGFTLTQNATNPDTERPFLCSATQPGSRPKSRHTKTDGHTLMTPEQVQTNMTLHTRNVVQLNTLIPRPGPLAHTRPLGTQALPNLFILSNDVFGSAHTRSHTHLP

SEQ ID NO: 831060 - protein, 114 aa, Homo sapiens; identical to SEQ ID NO: 831041

SEQ ID NO: 831061 - protein, 114 aa, Homo sapiens; identical to SEQ ID NO: 831041

SEQ ID NO: 831062 - protein, 114 aa, Homo sapiens; identical to SEQ ID NO: 831041

SEQ ID NO: 831063 - protein, 114 aa, Homo sapiens; identical to SEQ ID NO: 831041

SEQ ID NO: 831064 - protein, 114 aa, Homo sapiens; identical to SEQ ID NO: 831041

SEQ ID NO: 831065 - protein, 126 aa, Homo sapiens
MVTCLRLFCVGFTLTQNATNPDTERPFLCSATQPGSRPKSRHTKTDGHTLMTPEQVQTNMTLHTRNVVQLNTCRGEQAPWEASNGVHKRQVSSWGKKRPLGGDPHAPRVALTKGLKPESLGFVRYI

SEQ ID NO: 831066 - protein, 126 aa, Homo sapiens; identical to SEQ ID NO: 831065

SEQ ID NO: 831067 - protein, 68 aa, Homo sapiens
TASTRPGVNRPRPKFSRDSHFRPFGSLTAVTMTPAPWRLARTSALRKAAKREPRRKWLIHFLRKIGMM

SEQ ID NO: 831068 - protein, 68 aa, Homo sapiens; identical to SEQ ID NO: 831067

SEQ ID NO: 831069 - protein, 126 aa, Homo sapiens; identical to SEQ ID NO: 831065

SEQ ID NO: 831070 - protein, 75 aa, Homo sapiens
MAVGKNKRLTKGGKKGAKKKVVDPFSKKDWYDVKAPAMFNYKKYWKDARHQDPRGTTKLLCVSGGGLARELNSTD

SEQ ID NO: 831071 - protein, 92 aa, Homo sapiens; identical to SEQ ID NO: 831051

SEQ ID NO: 831072 - protein, 101 aa, Homo sapiens; identical to SEQ ID NO: 831037

SEQ ID NO: 831073 - protein, 84 aa, Homo sapiens
ISVLGWRLLVRYVCHRSCHILHGGKKGAKKKVVDPFSKKDWYDVKAPAMFNYKKYWKDARHQDPRGTKIASDGLKGRVFERESC

SEQ ID NO: 831074 - protein, 114 aa, Homo sapiens; identical to SEQ ID NO: 831041

SEQ ID NO: 831075 - protein, 84 aa, Homo sapiens; identical to SEQ ID NO: 831073

SEQ ID NO: 831076 - protein, 114 aa, Homo sapiens; identical to SEQ ID NO: 831041

SEQ ID NO: 831077 - protein, 114 aa, Homo sapiens; identical to SEQ ID NO: 831041

SEQ ID NO: 831078 - protein, 114 aa, Homo sapiens; identical to SEQ ID NO: 831041

SEQ ID NO: 831079 - protein, 114 aa, Homo sapiens; identical to SEQ ID NO: 831041

SEQ ID NO: 831080 - protein, 114 aa, Homo sapiens; identical to SEQ ID NO: 831041

SEQ ID NO: 831081 - protein, 114 aa, Homo sapiens; identical to SEQ ID NO: 831041

SEQ ID NO: 831082 - protein, 114 aa, Homo sapiens; identical to SEQ ID NO: 831041

SEQ ID NO: 831083 - protein, 114 aa, Homo sapiens; identical to SEQ ID NO: 831041

SEQ ID NO: 831084 - protein, 128 aa, Homo sapiens
TASTRPGVNRPRPKFSRDSHFRPFGSLTAVTMTPAPWRLARTSALRKAAKREPRRKLKNTVRIDLQWNLSIFLKSRVDPFSKKDWYDVKAPAMFNYKKYWKDARHQDPRGTKIASDGLKGRVFERESC

SEQ ID NO: 831085 - protein, 116 aa, Homo sapiens
MAVGKNKRLTKGGKKGAKKKVVDPFSKKDWYDVKAPAMFNYKKYWKDARHQDPRGTKELGILGMGSQKGIRVVSEKRGKGFSFGLEFLGQKMGCKVGIVAETFKLITERMFRVKTA

SEQ ID NO: 831086 - protein, 111 aa, Homo sapiens
TASTRPGVNRPRPKFSRDSHFRPFGSLTAVTMTPAPWRLARTSALRKAAKREPRRKCKSRLSWRLAFWGSAGIGGLVLDRGVGRMARIPVGLCGPWRVGAPRNAAWRVGVE

SEQ ID NO: 831087 - protein, 114 aa, Homo sapiens
MVTCLRLFCVGFTLTQNATNPDTERPFLCSATQPGSRPKSRHTKTDGHTLMTPEKVQTNMTLHTRNVVQLNTWIPRPGPLAHTRPLATQALPNLFILSNDVFASAHTRSHTHLL

SEQ ID NO: 831088 - protein, 170 aa, Homo sapiens
MVTCLRLFCVGFTLTQNATNPDTERPFLCSATQPGSRPKSRHTKTDGHTLMTPEQVQTNMTLHTRNVVQLNTLIPRPGPLAHTRPLGTQALPNLFILSNDVFGSAHTGAQGPGKFLGKKKATGGGPERTTGGPHTSFETRKPGIGEIYLKPTKLPRKILGSHTGSQNFPN

SEQ ID NO: 831089 - protein, 68 aa, Homo sapiens; identical to SEQ ID NO: 831067

SEQ ID NO: 831090 - protein, 126 aa, Homo sapiens; identical to SEQ ID NO: 831065

SEQ ID NO: 831091 - protein, 68 aa, Homo sapiens; identical to SEQ ID NO: 831067

SEQ ID NO: 831092 - protein, 68 aa, Homo sapiens; identical to SEQ ID NO: 831067

SEQ ID NO: 831093 - protein, 122 aa, Homo sapiens
MAVGKNKRLTKGGKKGAKKKVVDPFSKKDWYDVKAPAMFNYKKYWKDARHQDPRGTTKLASNGSQGSGVFKVSLADSQSDEVDIERYTLITRVYRKTTASITTSHGSHRHICATMTNVPTMM

SEQ ID NO: 831094 - protein, 170 aa, Homo sapiens
EEEEEEEEGAGVPACPPKGPGDVPLSPGAPLERPAEEEEDEEDGQEPGGLALPPPPPPPPPPPPRSREQRRNYQPRWRGEYLMDYDGSRRGLVCMVCGGALATLKVSTIKRHILQVHPFSMDFTPEERQTILEAYEEAALRCYGHEGFGPPAPAPRDGGADLKSGAVCRA

SEQ ID NO: 831095 - protein, 170 aa, Homo sapiens; identical to SEQ ID NO: 831094

SEQ ID NO: 831096 - protein, 170 aa, Homo sapiens; identical to SEQ ID NO: 831094

SEQ ID NO: 831097 - protein, 517 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831098 - protein, 524 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEVQGEQPKEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831099 - protein, 514 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEVQGEQPKPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831100 - protein, 358 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEVQGEQPKLPRRPATSSRRPSGR

SEQ ID NO: 831101 - protein, 488 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831102 - protein, 546 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGGVAWAGPFPLPPPGAPTPAQPSAPCVSHSTWGSWIGPDHDKFSAMKYEQGTGCWQGPNRSTTVRLLCGKETMVTSTTRAQSLRVPHGADDASRLPGATA

SEQ ID NO: 831103 - protein, 517 aa, Homo sapiens; identical to SEQ ID NO: 831097

SEQ ID NO: 831104 - protein, 517 aa, Homo sapiens; identical to SEQ ID NO: 831097

SEQ ID NO: 831105 - protein, 517 aa, Homo sapiens; identical to SEQ ID NO: 831097

SEQ ID NO: 831106 - protein, 685 aa, Homo sapiens
YRTLRGTKEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQDPMTVTTHRAPPVRERDHGDQHHRAQSLHHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831107 - protein, 388 aa, Homo sapiens
MAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831108 - protein, 357 aa, Homo sapiens
LWVRVTVWVSGDCWVLVTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831109 - protein, 502 aa, Homo sapiens
YRTLRGTKEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQDPMTVTTTVRLLCGKETMVTSTTEPSRYEYLMELDARKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831110 - protein, 366 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSERPDDMSPRAAACEKTMRPREKQLIRVAESR

SEQ ID NO: 831111 - protein, 331 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831112 - protein, 322 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPSPVPATPPSGD

SEQ ID NO: 831113 - protein, 299 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEHCPPTFQHLRFGKGTE

SEQ ID NO: 831114 - protein, 350 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEHLPTDLPDLLGLIVLPGWADRQMDRPTLPELLTWSSEITPLPSFPSPPTQRFFGSAQTYFSIKQLEP

SEQ ID NO: 831115 - protein, 256 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQPS

SEQ ID NO: 831116 - protein, 185 aa, Homo sapiens
YRTLRGTKEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNDTWGSWIGPDHDKFSAMKYEQGTGCWQGPNRSTTVRLLCGKETMVTSTTRAQSLRVPHGADDASRLPGATA

SEQ ID NO: 831117 - protein, 115 aa, Homo sapiens
MEFHRVGQAGLKLITSGDPPASASWVAGLHGTELVVVGGSPTSLGTWGSWIGPDHDKFSAMKYEQGTGCWQGPNRSTTVRLLCGKETMVTSTTRAQSLRVPHGADDASRLPGATA

SEQ ID NO: 831118 - protein, 518 aa, Homo sapiens
YRTLRGTKEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQDPMTVTTHRAPPVRERDHGDQHHRAQSLHHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEHLPTDLPDLLGLIVLPGWADRQMDRPTLPELLTWSSEITPLPSFPSPPTQRFFGSAQTYFSIKQLEP

SEQ ID NO: 831119 - protein, 43 aa, Homo sapiens
MLLPLLLLLPMCWAVEVKRPRGVSLTNHHFYDESALLPDVARV

SEQ ID NO: 831120 - protein, 517 aa, Homo sapiens; identical to SEQ ID NO: 831097

SEQ ID NO: 831121 - protein, 517 aa, Homo sapiens; identical to SEQ ID NO: 831097

SEQ ID NO: 831122 - protein, 517 aa, Homo sapiens; identical to SEQ ID NO: 831097

SEQ ID NO: 831123 - protein, 492 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNDTWGSWIGPDHDKFSAMKYEQGTGCWQGPNRSTTVRLLCGKETMVTSTTRAQSLRVPHGADDASRLPGATA

SEQ ID NO: 831124 - protein, 517 aa, Homo sapiens; identical to SEQ ID NO: 831097

SEQ ID NO: 831125 - protein, 551 aa, Homo sapiens
MLLPLLLLLPMCWAVEVKRPRGVSLTISRECSAGGDGRTEVVFGGEGAYLPWAELPVPQQNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831126 - protein, 524 aa, Homo sapiens; identical to SEQ ID NO: 831098

SEQ ID NO: 831127 - protein, 517 aa, Homo sapiens; identical to SEQ ID NO: 831097

SEQ ID NO: 831128 - protein, 528 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRVSQIALTQFLSSQPRSQ

SEQ ID NO: 831129 - protein, 385 aa, Homo sapiens
LRGELRWWRRLLLLLLLLLLLEPDGVIRSRGGEIGSDLMLMFWLVLMENWNPEKLPSSNKRAEGCLSQQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831130 - protein, 258 aa, Homo sapiens
MSDSRGYPFDGCLGAPVRYTYRVRALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831131 - protein, 219 aa, Homo sapiens
RPTRRGRVGRPTRRPRVRDAWEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTRAQSLRVPHGADDASRLPGATA

SEQ ID NO: 831132 - protein, 273 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATRLPGATA

SEQ ID NO: 831133 - protein, 321 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVLGPRRGWSTFPGPNSLQRWVKELALPGPPTLVTRPTTPSPVPATPPSGD

SEQ ID NO: 831134 - protein, 298 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQPSSVGDEGTGGCSSLGSVKSGAEGAGRSVGSASDRYLSLMAAQT

SEQ ID NO: 831135 - protein, 255 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQV

SEQ ID NO: 831136 - protein, 224 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAASRPTERAAADAFRTIRERDL

SEQ ID NO: 831137 - protein, 199 aa, Homo sapiens
MLLPLLLLLPMCWAVEVKRPRGVSLTNHHFYDESKPFTCLDGSATIPFDQVNDDYCDCKDGSDEPGEPFLCSSIRCLLNTAQCQALSVDQDTTSAGSPLSGQKQAQKSVVSVMAPGSWRSPESSSPKPRGQRRLLQGGTAACPNGSFHCTNTGYKPLYIPSNRVNDGVCDCCDGTDEYNSGVICENTCKYVGDSTPPIT

SEQ ID NO: 831138 - protein, 85 aa, Homo sapiens
EMLRTVKEEAEKPEREAKEQHQKLWEGMAEMAKDSPSVLGGSRSGPRSLPLIICCQFQQVFDHAAHRLVCFEVRLDCGICQEPPF

SEQ ID NO: 831139 - protein, 159 aa, Homo sapiens
MDKPRKENEEEPQSAPKTDEERPPVEHSPEKQSPEEQSSEEQSSEEEFFPEELLPELLPEMLLSEERPPQEGLSRKDLFEGRPPMEQPPCGVGKHKLEEGSFKERLARSRPQFRGDIHGRNLSNEEMIQAADELEEMKRVRNKLMIMHWKAKRSRPYPI

SEQ ID NO: 831140 - protein, 159 aa, Homo sapiens; identical to SEQ ID NO: 831139

SEQ ID NO: 831141 - protein, 159 aa, Homo sapiens; identical to SEQ ID NO: 831139

SEQ ID NO: 831142 - protein, 159 aa, Homo sapiens; identical to SEQ ID NO: 831139

SEQ ID NO: 831143 - protein, 159 aa, Homo sapiens; identical to SEQ ID NO: 831139

SEQ ID NO: 831144 - protein, 74 aa, Homo sapiens
KNRAGGFPGPRRWGGERCAGGGGGRGGAGPAEGGHLAEAQLPPCLSARAQSSDPCAGSRARPERGSSSSAVDRF

SEQ ID NO: 831145 - protein, 78 aa, Homo sapiens
GRSLTGGLDARPSPISEPGRLFSPFSRPGDGRHLVTRNLRSTENSGPGVMGPSGGSWQQSPPPPPGTHLSILSFDAEA

SEQ ID NO: 831146 - protein, 78 aa, Homo sapiens; identical to SEQ ID NO: 831145

SEQ ID NO: 831147 - protein, 84 aa, Homo sapiens
MRLRFNNDRMKTTIKETTILSSAILTFLTYLMKMSFERCTARNKMFVNSPFYPRVDNYCTSSWKKFYLKCYFSLNTIKKEKKMT

SEQ ID NO: 831148 - protein, 277 aa, Homo sapiens
MAAGRLFLSRLRAPFSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERSVYSDRYIFAKNLFENGSLSDIEWHIYQDWHSFLLWEFASRITLHGFIYLQASPQVCLKRLYQRAREEEKGIELAYLEQLHGQHEAWLIHKTTKLHFEALMNIPVLVLDVNDDFSEEVTKQEDLMREVNTFVKNL

SEQ ID NO: 831149 - protein, 180 aa, Homo sapiens
MMYREPARWSYTFQTFSFLSRLKVQLEPFPEKLLQARKPVQIFERSVYSDRYIFAKNLFENGSLSDIEWHIYQDWHSFLLWEFASRITLHGFIYLQASPQVCLKRLYQRAREEEKGIELAYLEQLHGQHEAWLIHKTTKLHFEALMNIPVLVLDVNDDFSEEVTKQEDLMREVNTFVKNL

SEQ ID NO: 831150 - protein, 180 aa, Homo sapiens; identical to SEQ ID NO: 831149

SEQ ID NO: 831151 - protein, 174 aa, Homo sapiens
MMYREPARWSYTFQTFSFLSRLKVQLEPFPEKLLQARKPVQIFERYIFAKNLFENGSLSDIEWHIYQDWHSFLLWEFASRITLHGFIYLQASPQVCLKRLYQRAREEEKGIELAYLEQLHGQHEAWLIHKTTKLHFEALMNIPVLVLDVNDDFSEEVTKQEDLMREVNTFVKNL

SEQ ID NO: 831152 - protein, 153 aa, Homo sapiens
SLSRAFHSISHSPALPIPIPLPTRYIFAKNLFENGSLSDIEWHIYQDWHSFLLWEFASRITLHGFIYLQASPQVCLKRLYQRAREEEKGIELAYLEQLHGQHEAWLIHKTTKLHFEALMNIPVLVLDVNDDFSEEVTKQEDLMREVNTFVKNL

SEQ ID NO: 831153 - protein, 180 aa, Homo sapiens; identical to SEQ ID NO: 831149

SEQ ID NO: 831154 - protein, 180 aa, Homo sapiens; identical to SEQ ID NO: 831149

SEQ ID NO: 831155 - protein, 103 aa, Homo sapiens
KHNLSNFSFKMLQVPKKTMAKSNHNLTNQLLSGTSDRCVNRGWDGRGPPLSKSASSTLQFHGQEPTRGRFLLQRPARGARAPKALHRRQHWPALPKVLETCWI

SEQ ID NO: 831156 - protein, 189 aa, Homo sapiens
MAAGRLFLSRLRAPFSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERSVYSDRLHFEALMNIPVLVLDVNDDFSEEVTKQEDLMREVNTFVKNL

SEQ ID NO: 831157 - protein, 103 aa, Homo sapiens; identical to SEQ ID NO: 831155

SEQ ID NO: 831158 - protein, 183 aa, Homo sapiens
MAAGRLFLSRLRAPFSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERLHFEALMNIPVLVLDVNDDFSEEVTKQEDLMREVNTFVKNL

SEQ ID NO: 831159 - protein, 90 aa, Homo sapiens
KHNLSNFSFKMLQVPKKTMAKSNHNLTNQLLSGTSDRCVNRGWDGRGPPLSKSASSTLQFHGQEPTRGRFLLQRPARGARAPKALHRRQH

SEQ ID NO: 831160 - protein, 209 aa, Homo sapiens
MAAGRLFLSRLRAPFSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERSVYSDRYIFAKNLFENGSLSDIEWHIYQDWHSFLLWEFASRITLHGFIYLQASPQFCLKDCTLSSEE

SEQ ID NO: 831161 - protein, 132 aa, Homo sapiens
KHNLSNFSFKMLQVPKKTMAKSNHNLTNQLLSGTSDRCVNRGWDGRGPPLSKSASSTLQFHGQEPTRGRFLLQRPARGARAPKALHRRQHWLHFEALMNIPVLVLDVNDDFSEEVTKQEDLMREVNTFVKNL

SEQ ID NO: 831162 - protein, 103 aa, Homo sapiens; identical to SEQ ID NO: 831155

SEQ ID NO: 831163 - protein, 122 aa, Homo sapiens
MNIPVLVLDVNDDFSEEVSHINHLRVQQHPTVLVPRVNFLKNHRLAHPIMLPVPFLPRAESTSAHQWGRKASLFRTLHAPGIQGNAPATPISLEFLGLPPLARRFPFLVPGAAAQPGSDLAG

SEQ ID NO: 831164 - protein, 180 aa, Homo sapiens; identical to SEQ ID NO: 831149

SEQ ID NO: 831165 - protein, 103 aa, Homo sapiens; identical to SEQ ID NO: 831155

SEQ ID NO: 831166 - protein, 189 aa, Homo sapiens; identical to SEQ ID NO: 831156

SEQ ID NO: 831167 - protein, 132 aa, Homo sapiens; identical to SEQ ID NO: 831161

SEQ ID NO: 831168 - protein, 172 aa, Homo sapiens
MAAGRLFLSRLRAPFSSMAKSPLEGVSSSRGLHAGRGPRRLSIEGNIAVGKSTFVKLLTKTYPEWHVATEPVATWQNIQAAGTQKPARWSYTFQTFSFLSRLKVQLEPFPEKLLQARKPVQIFERSVYSDRLHFEALMNIPVLVLDVNDDFSEEVTKQEDLMREVNTFVKNL

SEQ ID NO: 831169 - protein, 103 aa, Homo sapiens; identical to SEQ ID NO: 831155

SEQ ID NO: 831170 - protein, 189 aa, Homo sapiens; identical to SEQ ID NO: 831156

SEQ ID NO: 831171 - protein, 132 aa, Homo sapiens; identical to SEQ ID NO: 831161

SEQ ID NO: 831172 - protein, 169 aa, Homo sapiens
MAAGRLFLSRLRAPFSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERSVYSDSILAKIFFVLLWEFASGSHYMA

SEQ ID NO: 831173 - protein, 132 aa, Homo sapiens; identical to SEQ ID NO: 831161

SEQ ID NO: 831174 - protein, 82 aa, Homo sapiens [sequence omitted]

SEQ ID NO: 831175 - protein, 95 aa, Homo sapiens
PTRSDMICGYACLKGTAAMRNTKRGSWYIEALAQVFSERACDMHVADMLVKVNALHCSGYVEKLLLKLNKDDLFKFSGRKQSSSPHFKFFLLKFS

SEQ ID NO: 831176 - protein, 452 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 831177 - protein, 296 aa, Homo sapiens
MWNSSTCCLRGVPKLLMPSVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 831178 - protein, 296 aa, Homo sapiens; identical to SEQ ID NO: 831177

SEQ ID NO: 831179 - protein, 501 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPDEALVIWGLGRVSLTGKEFVSQSEGDKILLYLDRTTSLRSVIMSFDFLQLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 831180 - protein, 441 aa, Homo sapiens
MHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGGAIGSLGHLLLFTAATASLLYETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 831181 - protein, 452 aa, Homo sapiens; identical to SEQ ID NO: 831176

SEQ ID NO: 831182 - protein, 352 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNFSLPASLSSHPGDPAWFFPSCWSTPRSVSSPRQAWMKNILGWFCRLGQLG

SEQ ID NO: 831183 - protein, 136 aa, Homo sapiens
ESKSVLKHASGAVRRRGENDPRTDQSPRAAASRVQHLRPAAVAAATMPKRKAEGDAKGDKAKVKDEPQRRSARLSAKPAPPKPEPKPKKAPAKKGEKVPKGKKGKADAGKEGNNPAENGDAKTDQAQKAEGAGDAK

SEQ ID NO: 831184 - protein, 700 aa, Homo sapiens [sequence omitted]

SEQ ID NO: 831185 - protein, 570 aa, Homo sapiens
MEQELEARTRELSRTQEELMNSNQMSSDLSQKLEELQRHYSTLEEQRDHVIASKTGAESKITALEQKEQELQALIQQLSIDLQKVTAETQEKEDVITHLQEKVASLEKRLEQNLSGEEHVQELLKEKTLAEQNLEDTRQQLLAARSSQAKAINTLETRVRELEQTLQASEEQLQQSKGIVAAQETQIQELAAANQESSHVQQQALALEQQFLERTQALEAQIVALERTRAADQTTAEQGMRQLEQENAALKECRNEYERSLQNHQFELKKLKEEWSQREIVSVAMAQALEEVRKQREEFQQQAANLTAIIDEKEQNLREKTEVLLQKEQEILQLERGHNSALLQIHQLQAELEALRTLKAEEAAVVAEQEDLLRLRGPLQAEALSVNESHVTSRAMQDPVFQLPTAGRTPNGEVGAMDLTQLQKEKQDLEQQLLEKNKTIKQMQQRMLELRKTLQKELKIRPDNELFEVREKPGPEMANMAPSVTNNTDLTDAREINFEYLKHVVLKFMSCRESEAFHLIKAVSVLLNFSQEEENMLKETLEYKMSWFGSKPAPKGSIRPSISNPRIPWS

SEQ ID NO: 831186 - protein, 82 aa, Homo sapiens
GRSNIRPRAEFGTRCYHSGHQTGGSWHYPDFHSAANIPAPASTPSAPESSNFTVALTAEAISIWQAHLSHHVALLLEVETAL

SEQ ID NO: 831187 - protein, 399 aa, Homo sapiens
MFAKLKKKIAEETAVAQRPGGATRIPRSVSKESVASMGADSGDDFASDGSSSREDLSSQLLRRNEQIRKLEARLSDYAEQVRNLQKIKEKLEIALEKHQDSSMRKFQEQNETFQANRAKMAEGLALALARKDQEWSEKMDQLEKEKNILTAQLQEMKNQSMNLFQRRDEMDELEGFQQQELSKIKHMLLKKEESLGKMEQELEARTRELSRTQEELMNSNQMSSDLSQKLEELQRHYSTLEEQRDHVIASKTGAESKITALEQKEQELQALIQQLSIDLQKVTAETQEKEDVITHLQEKVASLEKRLEQNLSGEEHVQELLKEKTLAEQNLEDTRQQLLAARSSQAKAINTLETRVRELEQTLQASEEQLQQSKGIVAAQETQIQELVSAYWSCCIPGP

SEQ ID NO: 831188 - protein, 767 aa, Homo sapiens
MFAKLKKKIAEETAVAQRPGGATRIPRSVSKESVASMGADSGDDFASDGSSSREDLSSQLLRRNEQIRKLEARLSDYAEQVRNLQKIKEKLEIALEKHQDSSMRKFQEQNETFQANRAKMAEGLALALARKDQEWSEKMDQLEKEKNILTAQLQEMKNQSMNLFQRRDEMDELEGFQQQELSKIKHMLLKKEESLGKMEQELEARTRELSRTQEELMNSNQMSSDLSQKLEELQRHYSTLEEQRDHVIASKTGAESKITALEQKEQELQALIQQLSIDLQKVTAETQEKEDVITHLQEKVASLEKRLEQNLSGEEHVQELLKEKTLAEQNLEDTRQQLLAARSSQAKAINTLETRVRELEQTLQASEEQLQQSKGIVAAQETQIQELAAANQESSHVQQQALALEQQFLERTQALEAQIVALERTRAADQTTAEQGMRQLEQENAALKECRNEYERSLQNHQFELKKLKEEWSQREIVSVAMAQALEEVRKQREEFQQQAANLTAIIDEKEQNLREKTEVLLQKEQEILQLERGHNSALLQIHQLQAELEALRTLKAEEAAVVAEQEDLLRLRGPLQAEALSVNESHVTSRAMQDPVFQLPTAGRTPNGEVGAMDLTQLQKEKQDLEQQLLEKNKTIKQMQQRMLELRKTLQKELKIRPDNELFEVREKPGPEMANMAPSVTNNTDLTDAREINFEYLKHVVLKFMSCRESEAFHLIKAVSVLLNFSQEEENMLKETLEYKMSWFGSKPAPKGSIRPSISNPRIPWS

SEQ ID NO: 831189 - protein, 767 aa, Homo sapiens; identical to SEQ ID NO: 831188

SEQ ID NO: 831190 - protein, 122 aa, Homo sapiens
HHLSPSLGPTGEPCTSAALKPAFHFRTFLKSRRIFRSMASYCVTGDTLTVTRTLTLSALSLWPASPTWLPSGTPPESPCSAATGGRDGPLRWCPAGQTHLPLPGTANSMGTLWEWLLKIQMS

SEQ ID NO: 831191 - protein, 197 aa, Homo sapiens
MFAKLKKKIAEETAVAQRPGGATRIPRSVSKESVASMGADSGDDFASDGSSSREDLSSQLLRRNEQIRKLEARLSDYAEQVRNLQKIKEKLEIALEKHQDSSMRKFQEQNETFQANRAKMAEGLALALARKDQEWSEKMDQLEKEKNILTAQLQEMKNQSMNLFQRRDEMDELEGFQQQELSKIKHMVCIFVLVAKY

SEQ ID NO: 831192 - protein, 429 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSNLRKLRNVSNLKPVPLIGPKLKRRWPISYCRELKGYSIPFMGSDVSVVRRTQRYLYENLEESPVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 831193 - protein, 429 aa, Homo sapiens; identical to SEQ ID NO: 831192

SEQ ID NO: 831194 - protein, 429 aa, Homo sapiens; identical to SEQ ID NO: 831192

SEQ ID NO: 831195 - protein, 342 aa, Homo sapiens [sequence omitted]

SEQ ID NO: 831196 - protein, 237 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSNLRKLRNVSNLKPVPLIVPFLLWDLMCLL

SEQ ID NO: 831197 - protein, 233 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSNCGQFLIVGNSKVIPFLLWDLMCLL

SEQ ID NO: 831198 - protein, 225 aa, Homo sapiens
SLSLSLSLSLSLSLLKPVPLIGPKLKRRWPISYCRELKGYSIPFMGSDVSVVRRTQRYLYENLEESPVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 831199 - protein, 171 aa, Homo sapiens
MLHTILENLEESPVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 831200 - protein, 125 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPVSNQPFFVSEQTIHSFLAKYSRGT

SEQ ID NO: 831201 - protein, 209 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSN

SEQ ID NO: 831202 - protein, 429 aa, Homo sapiens; identical to SEQ ID NO: 831192

SEQ ID NO: 831203 - protein, 411 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSNLRKLRNVSNLKPVPLIGPKLKRRWPISYCRELKGYSIPFMGSDVSVVRRTQRYLYENLEESPVQYAAYVTVGGITSVIKLMFAGLFFLFFVRFGIGRQLLIKFPWFFSFGYFSKQGPTQKQIDAASFTLTFFGQGYSQGTEAGYVATPIAMVQAAMTLLSDASHLPKAGGVFTPGAAFSKTKLIDRLNKHGIEFSVISSSEV

SEQ ID NO: 831204 - protein, 402 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPFLELMQLKYHEKAADKGVYIIGSSGFDSIPADLGVIYTRNKMNGTLTAVESFLTIHSGPEGLSIHDGTWKSAIYGFGDQSNLRKLRNVSNLKPVPLIGPKLKRRWPISYCRELKGYSIPFMGSDVSVVRRTQRYLYENLEESPVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 831205 - protein, 176 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGVEHS

SEQ ID NO: 831206 - protein, 166 aa, Homo sapiens
NFVFSIIEVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 831207 - protein, 109 aa, Homo sapiens
MIPLSPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 831208 - protein, 839 aa, Homo sapiens [sequence omitted]

SEQ ID NO: 831209 - protein, 839 aa, Homo sapiens [sequence omitted]

SEQ ID NO: 831210 - protein, 839 aa, Homo sapiens [sequence omitted]

SEQ ID NO: 831211 - protein, 839 aa, Homo sapiens [sequence omitted]

SEQ ID NO: 831212 - protein, 512 aa, Homo sapiens
IGRRLPAPAPPPWAKSADLWGRWLQTGAARVREIMAARPITLGIDLGTTSVKAALLRAAPDDPSGFAVLASCARAARAEAAVESAVAGPQGREQDVSRILQALHECLAALPRPQLRSVVGIGVSGQMHGVVFWKTGQGCEWTEGGITPVFEPRAVSHLVTWQDGRCSSEFLASLPQPKSHLSVATGFGCATIFWLLKYRPEFLKSYDAAGTIHDYVVAMLCGLPRPLMSDQNAASWGYFNTQSQSWNVKTLRSSGFPVHLLPDIAEPGSVAGRTSHMWFEIPKGTQVGVALGDLQASVYSCMAQRTDAVLNISTSVQLAASMPSGFQPAQTPDPTAPVAYFPYFNRTYLGVAASLNGGNVLATFVHMLVQWMADLGLEVEESTVYSRMIQAAVQQRDTHLTITPTVLGERHLPDQLASVTRISSSDLSLGHVTRALCRGIVQNLHSMLPIQQLQEWGVERVMGSGSALSRNDVLKQEVQRAFPLPMSFGQDVDAAVGAALVMLRRHLNQKES

SEQ ID NO: 831213 - protein, 839 aa, Homo sapiens [sequence omitted]

SEQ ID NO: 831214 - protein, 512 aa, Homo sapiens; identical to SEQ ID NO: 831212

SEQ ID NO: 831215 - protein, 101 aa, Homo sapiens
EIIQLADRYYKGQTALHIAIERRNMALVTLLVENGADVQAAAHGDFFKKTKGRPGFYFGELPLSLAACTNQLGIVKFLLQNSWLIWGIFFLDKGSAPCGQP

SEQ ID NO: 831216 - protein, 839 aa, Homo sapiens [sequence omitted]

SEQ ID NO: 831217 - protein, 839 aa, Homo sapiens [sequence omitted]

SEQ ID NO: 831218 - protein, 649 aa, Homo sapiens
EIIQLADRYYKGQTALHIAIERRNMALVTLLVENGADVQAAAHGDFFKKTKGRPGFYFGELPLSLAACTNQLGIVKFLLQNSWQTADISARDSVGNTVLHALVEVADNTADNTKFVTSMYNEILILGAKLHPTLKLEELTNKKGMTPLALAAGTGKIGVLAYILQREIQEPECRHLSRKFTEWAYGPVHSSLYDLSCIDTCEKNSVLEVIAYSSSETPNRHDMLLVEPLNRLLQDKWDRFVKRIFYFNFLVYCLYMIIFTMAAYYRPVDGLPPFKMEKIGDYFRVTGEILSVLGGVYFFFRGIQYFLQRRPSMKTLFVDSYSEMLFFLQSLFMLATVVLYFSHLKEYVASMVFSLALGWTNMLYYTRGFQQMGIYAVMIEKMILRDLCRFMFVYIVFLFGFSTAVVTLIEDGKNDSLPSESTSHRWRGPACRPPDSSYNSLYSTCLELFKFTIGMGDLEFTENYDFKAVFIILLLAYVILTYILLLNMLIALMGETVNKIAQESKNIWKLQRAITILDTEKSFLKCMRKAFRSGKLLQVGYTPDGKDDYRWCFRVDEVNWTTWNTNVGIINEDPGNCEGVKRTLSFSLRSSRVSGRHWKNFALVPLLREASARDRQSAQPEEVYLRQFSGSLKPEDAEVFKSPAASGEK

SEQ ID NO: 831219 - protein, 186 aa, Homo sapiens
MSGISGCPFFLWGLLALLGLALVISLIFNISHYVEKQRQDKMYSYSSDHTRVDEYYIEDTPIYGNLDDMISEPMDENCYEQMKARPEKSVNKMQEATPSAQATNETQMCYASLDHSVKGKRRKPRKQNTHFSDKDGDEQLHAIDASVSKTTLVDSFSPESQAVEENIHDDPIRLFGLIRAKREPIN

SEQ ID NO: 831220 - protein, 145 aa, Homo sapiens
MYSYSSDHTRVDEYYIEDTPIYGNLDDMISEPMDENCYEQMKARPEKSVNKMQEATPSAQATNETQMCYASLDHSVKGKRRKPRKQNTHFSDKDGDEQLHAIDASVSKTTLVDSFSPESQAVEENIHDDPIRLFGLIRAKREPIN

SEQ ID NO: 831221 - protein, 149 aa, Homo sapiens
MSDKMYSYSSDHTRVDEYYIEDTPIYGNLDDMISEPMDENCYEQMKARPEKSVNKMQEATPSAQATNETQMCYASLDHSVKGKRRKPRKQNTHFSDKDGDEQLHAIDASVSKTTLVDSFSPESQAVEENIHDDPIRLFGLIRAKREPIN

SEQ ID NO: 831222 - protein, 82 aa, Homo sapiens
MGREFGNLTRMRHVISYSLSPFEQRAYPHVFTKGIPNVLRRIRESFFRVVPQFVVFYLIYTWGTEEFERSKRKNPAAYENDK

SEQ ID NO: 831223 - protein, 82 aa, Homo sapiens; identical to SEQ ID NO: 831222

SEQ ID NO: 831224 - protein, 86 aa, Homo sapiens
KFSGRVDVRFPNSRMRHVISYSLSPFEQRAYPHVFTKGIPNVLRRIRESFFRVVPQFVVFYLIYTWGTEEFERSKRKNPAAYENDK

SEQ ID NO: 831225 - protein, 93 aa, Homo sapiens
MGREFGNLTRMRHVISYSLSPFEQRAYPHVFTKGIPNVLRRIRESFFRVVPQFVVFYLIYTWGTEEFERSKRRIQLPMKMTNEQRIRMTVPCL

SEQ ID NO: 831226 - protein, 82 aa, Homo sapiens; identical to SEQ ID NO: 831222

SEQ ID NO: 831227 - protein, 39 aa, Homo sapiens
MGREFGNLTRMRHVISYSLSPFEQRAYPHVFTKGIPNVL

SEQ ID NO: 831228 - protein, 82 aa, Homo sapiens; identical to SEQ ID NO: 831222

SEQ ID NO: 831229 - protein, 82 aa, Homo sapiens; identical to SEQ ID NO: 831222

SEQ ID NO: 831230 - protein, 93 aa, Homo sapiens; identical to SEQ ID NO: 831225

SEQ ID NO: 831231 - protein, 82 aa, Homo sapiens; identical to SEQ ID NO: 831222

SEQ ID NO: 831232 - protein, 163 aa, Homo sapiens
MRLSPFHLQLEFHMKEKREDLQISWSFISVPEMAVNIQPKALGEDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTL

SEQ ID NO: 831233 - protein, 227 aa, Homo sapiens
MGGTTSTRRVTFEADENENITVVKGIRLSENVIDRMKESSPSGSKSQRYSGAYGASVSDEELKRRVAEELALEQAKKESEDQKRLKQAKELDRERAAANEQLTRAILRERICSEEERAKAKHLARQLEEKDRVLKKQDAFYKEQLARLEERSSEFYRVTTEQYQKAAEEVEAKFKRYESHPVCADLQAKILQCYRENTHQTLKCSALATQYMHCVNHAKQSMLEKGG

SEQ ID NO: 831234 - protein, 138 aa, Homo sapiens
MGGTTSTRRVTFEADENENITVVKGIRLSENVIDRMKESSPSGSKSQRYSGAYGASVSDEELKRRVAEELALEQAKKESEDQKRLKQAKELDRERAAANEQLTRAILRERICSEEERAKAKHLIKVELLWVKPGVLTA

SEQ ID NO: 831235 - protein, 227 aa, Homo sapiens; identical to SEQ ID NO: 831233

SEQ ID NO: 831236 - protein, 227 aa, Homo sapiens; identical to SEQ ID NO: 831233

SEQ ID NO: 831237 - protein, 210 aa, Homo sapiens
MGGTTSTRRVTFEADENENITVVKGIRLFYLLLLFIDSEFSDEELKRRVAEELALEQAKKESEDQKRLKQAKELDRERAAANEQLTRAILRERICSEEERAKAKHLARQLEEKDRVLKKQDAFYKEQLARLEERSSEFYRVTTEQYQKAAEEVEAKFKRYESHPVCADLQAKILQCYRENTHQTLKCSALATQYMHCVNHAKQSMLEKGG

SEQ ID NO: 831238 - protein, 118 aa, Homo sapiens
MHSTKNSWLDWRRGAQSSTESPLNNIRKLLKRWKQSSSDMSLIQSVLICRPKFFSVTVRTPTRPSNAPLWPPSICTVSIMPNRACLRREDKNFQNEQNTINVNSRDGTFFFLVRKQPI

SEQ ID NO: 831239 - protein, 118 aa, Homo sapiens; identical to SEQ ID NO: 831238

SEQ ID NO: 831240 - protein, 70 aa, Homo sapiens
ADVETRYPLFEGPETGKKRPSRNEDHFDHFGPLALIKKKKLQLELKRDIKNGFSRIISRFEQQQFEGPKP

SEQ ID NO: 831241 - protein, 71 aa, Homo sapiens
MGGTTSTRRVTFEADENENITVVKGIRVSARGRAEGQWLDSDPKAPSFRTRSAWVSPVLDPSVLRPEAQVS

SEQ ID NO: 831242 - protein, 175 aa, Homo sapiens
MGGTTSTRRVTFEADENENITVVKGIRLSENVIDRMKESSPSGSKSQRYSGAYGASVSDEELKRRVAEELALEQAKKESEDQKRLKQAKELDRERAAANEQLTRAILRERICSEEERAKAKHLARQLEEKDRVLKKQDAFYKEQLARLEERSSEFYRVTTEQYQKAAEEVEAKFK

SEQ ID NO: 831243 - protein, 227 aa, Homo sapiens; identical to SEQ ID NO: 831233

SEQ ID NO: 831244 - protein, 220 aa, Homo sapiens
MGGTTSTRRVTFEADEKKKEEKGKQEKEKKRKETTGKKRKGAKGAKEEEVSDEELKRRVAEELALEQAKKESEDQKRLKQAKELDRERAAANEQLTRAILRERICSEEERAKAKHLARQLEEKDRVLKKQDAFYKEQLARLEERSSEFYRVTTEQYQKAAEEVEAKFKRYESHPVCADLQAKILQCYRENTHQTLKCSALATQYMHCVNHAKQSMLEKGG

SEQ ID NO: 831245 - protein, 209 aa, Homo sapiens
MGGTTSTRRVTFEADENENITVVKGIRLSENVIDRMKESSPSGSKSQRYSGAYGASVSDEELDQKRLKQAKELDRERAAANEQLTRAILRERICSEEERAKAKHLARQLEEKDRVLKKQDAFYKEQLARLEERSSEFYRVTTEQYQKAAEEVEAKFKRYESHPVCADLQAKILQCYRENTHQTLKCSALATQYMHCVNHAKQSMLEKGG

SEQ ID NO: 831246 - protein, 105 aa, Homo sapiens
MCSLTLIFILNEDHWSQRSLCLFSGDMSLIQSVLICRPKFFSVTVRTPTRPSNAPLWPPSICTVSIMPNRACLRREDKNFQNEQNTINVNSRDGTFFFLVRKQPI

SEQ ID NO: 831247 - protein, 107 aa, Homo sapiens
MGGTTSTRRVTFEADENENITVVKGIRLSENVIDRMKESSPSGSKSQRYSGAYGASVSDEELKRRVAEELALEQAKKESEDQKRRTKASPKELEPEERGLGGQMEPG

SEQ ID NO: 831248 - protein, 432 aa, Homo sapiens
GGSAAGTTAVPTAIRPPGLACPCARLPSARRPPAALPRSVPPRPRPAGMQRSPPGYGAQDDPPARRDCAWAPGHGAAADTRGLAAGPAALAAPAAPASPPSPQRSPPRSPEPGRYGLSPAGRGERQAADESRIRRPMNAFMVWAKDERKRLAQQNPDLHNAVLSKMLGKAWKELNAAEKRPFVEEAERLRVQHLRDHPNYKYRPRRKKQARKARRLEPGLLLPGLAPPQPPPEPFPAASGSARAFRELPPLGAEFDGLGLPTPERSPLDGLEPGEAAFFPPPAAPEDCALRPFRAPYAPTELSRDPGGCYGAPLAEALRTAPPAAPLAGLYYGTLGTPGPYPGPLSPPPEAPPLESAEPLGPAADLWADVDLTEFDQYLNCSRTRPDAPGLPYHVALAKLGPRAMSCPEESSLISALSDASSAVYYSACISG

SEQ ID NO: 831249 - protein, 432 aa, Homo sapiens; identical to SEQ ID NO: 831248

SEQ ID NO: 831250 - protein, 378 aa, Homo sapiens
GGSAAGTTAVPTAIRPPGLACPCARLPSARRPPAALAAPAAPASPPSPQRSPPRSPEPGRYGLSPAGRGERQAADESRIRRPMNAFMVWAKDERKRLAQQNPDLHNAVLSKMLGKAWKELNAAEKRPFVEEAERLRVQHLRDHPNYKYRPRRKKQARKARRLEPGLLLPGLAPPQPPPEPFPAASGSARAFRELPPLGAEFDGLGLPTPERSPLDGLEPGEAAFFPPPAAPEDCALRPFRAPYAPTELSRDPGGCYGAPLAEALRTAPPAAPLAGLYYGTLGTPGPYPGPLSPPPEAPPLESAEPLGPAADLWADVDLTEFDQYLNCSRTRPDAPGLPYHVALAKLGPRAMSCPEESSLISALSDASSAVYYSACISG

SEQ ID NO: 831251 - protein, 432 aa, Homo sapiens; identical to SEQ ID NO: 831248

SEQ ID NO: 831252 - protein, 432 aa, Homo sapiens; identical to SEQ ID NO: 831248

SEQ ID NO: 831253 - protein, 1167 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 831254 - protein, 1167 aa, Homo sapiens; identical to SEQ ID NO: 831253

SEQ ID NO: 831255 - protein, 874 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKVCGIDMLL

SEQ ID NO: 831256 - protein, 1130 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEEAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 831257 - protein, 1059 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 831258 - protein, 510 aa, Homo sapiens
KKQLEDGRYYFLDYNIRRSTNCIYDLSQRGGMQIFVKTLTGKTITLEVEPSDTIENVKAKIQDKESIPPDQQRLIFAGKQLEDGRTHSDYNILLAGDTAKQDSQQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 831259 - protein, 350 aa, Homo sapiens
MPLEINADLFVYISIATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 831260 - protein, 103 aa, Homo sapiens
MDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 831261 - protein, 1113 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTR

SEQ ID NO: 831262 - protein, 871 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMV

SEQ ID NO: 831263 - protein, 102 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVSTGFAFSLPY

SEQ ID NO: 831264 - protein, 1190 aa, Homo sapiens [sequence omitted]

SEQ ID NO: 831265 - protein, 1139 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDAHRGPPDEKQSERRVWSPAGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 831266 - protein, 1149 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKNWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 831267 - protein, 1103 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIFQTP

SEQ ID NO: 831268 - protein, 1167 aa, Homo sapiens; identical to SEQ ID NO: 831253

SEQ ID NO: 831269 - protein, 218 aa, Homo sapiens [sequence omitted]

SEQ ID NO: 831270 - protein, 874 aa, Homo sapiens; identical to SEQ ID NO: 831255

SEQ ID NO: 831271 - protein, 1019 aa, Homo sapiens
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEEPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKVRGWEAPGWEGRGSRCPLKPPWTAQGGACTLRWCLITVLTHCVLY

SEQ ID NO: 831272 - protein, 262 aa, Homo sapiens
KWRERQGGALHPVRQLKLGARVTPAATPPGPTDTTAAPALSLLGRAMGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 831273 - protein, 262 aa, Homo sapiens; identical to SEQ ID NO: 831272

SEQ ID NO: 831274 - protein, 261 aa, Homo sapiens
LYRLGTRRVVNRPRLKLGARVTPAATPPGPTDTTAAPALSLLGRAMGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 831275 - protein, 262 aa, Homo sapiens; identical to SEQ ID NO: 831272

SEQ ID NO: 831276 - protein, 227 aa, Homo sapiens
LSRSPSDGFFASLLALPSVQTPITVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 831277 - protein, 244 aa, Homo sapiens
KWRERQGGALHPVRQLKLGARVTPAATPPGPTDTTAAPALSLLGRAMGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEAAFQTILTEIYRIVSQKQMSDRRENDMSPSNNVVPIHVPPTTENKPKVQCCQNI

SEQ ID NO: 831278 - protein, 111 aa, Homo sapiens
GPALSGPADSNIVIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 831279 - protein, 92 aa, Homo sapiens
GSVRIRLSGQFLQMKQSFAEKNGLSFIETSALDSTNVEAAFQTILTEIYRIVSQKQMSDRRENDMSPSNNVVPIHVPPTTENKPKVQCCQNI

SEQ ID NO: 831280 - protein, 86 aa, Homo sapiens
LVDQAERNSSDLSNFKKERKNELKCNGMIFAHCNLRLLDSKIYRIVSQKQMSDRRENDMSPSNNVVPIHVPPTTENKPKVQCCQNI

SEQ ID NO: 831281 - protein, 262 aa, Homo sapiens; identical to SEQ ID NO: 831272

SEQ ID NO: 831282 - protein, 90 aa, Homo sapiens
CVTLVFYYFILMKQSFAEKNGLSFIETSALDSTNVEAAFQTILTEIYRIVSQKQMSDRRENDMSPSNNVVPIHVPPTTENKPKVQCCQNI

SEQ ID NO: 831283 - protein, 262 aa, Homo sapiens; identical to SEQ ID NO: 831272

SEQ ID NO: 831284 - protein, 262 aa, Homo sapiens; identical to SEQ ID NO: 831272

SEQ ID NO: 831285 - protein, 217 aa, Homo sapiens
SRGSRSLSTRYPFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 831286 - protein, 244 aa, Homo sapiens
KWRERQGGALHPVRQLKLGARVTPAATPPGPTDTTAAPALSLLGRAMGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYDIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 831287 - protein, 221 aa, Homo sapiens
KWRERQGGALHPVRQLKLGARVTPAATPPGPTDTTAAPALSLLGRAMGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEQMSDRRENDMSPSNNVVPIHVPPTTENKPKVQCCQNI

SEQ ID NO: 831288 - protein, 1116 aa, Homo sapiens
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831289 - protein, 288 aa, Homo sapiens
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKTTRGGYCWMRPPGVDERDLSFRSTGWWLTDYLGQAGLTLVGTPFRIGGCIRKAKINWRRTVW

SEQ ID NO: 831290 - protein, 1116 aa, Homo sapiens; identical to SEQ ID NO: 831288

SEQ ID NO: 831291 - protein, 819 aa, Homo sapiens
TLVRPRVGISSTSAVADFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831292 - protein, 578 aa, Homo sapiens
MNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831293 - protein, 957 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAVAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831294 - protein, 522 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAVTA

SEQ ID NO: 831295 - protein, 418 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSRTHLRSPSPSVP

SEQ ID NO: 831296 - protein, 975 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831297 - protein, 261 aa, Homo sapiens
MKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSRTHLRSPSPSVP

SEQ ID NO: 831298 - protein, 975 aa, Homo sapiens; identical to SEQ ID NO: 831296

SEQ ID NO: 831299 - protein, 975 aa, Homo sapiens; identical to SEQ ID NO: 831296

SEQ ID NO: 831300 - protein, 975 aa, Homo sapiens; identical to SEQ ID NO: 831296

SEQ ID NO: 831301 - protein, 980 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSQLAQTQPHPGLIISIIPLLFFNLSTTTIFSCSQLAQTYS

SEQ ID NO: 831302 - protein, 971 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSAMTEIVSRVSKRKLGRHVRALVLELCCNDESGEDVEVPYVRYTIPLTPSAPLGWPLVNPSPHPFQPAAKLKERLYQPMTEIVSRVSKRKLGPPRAGAGA

SEQ ID NO: 831303 - protein, 971 aa, Homo sapiens; identical to SEQ ID NO: 831302

SEQ ID NO: 831304 - protein, 883 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRRHVRALVLELCCNDESGEDVEVPYVRYTIR

SEQ ID NO: 831305 - protein, 243 aa, Homo sapiens
MRTELWQAQSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831306 - protein, 927 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831307 - protein, 868 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQSDTPSADPVCSSRLAPCPPLSTPLPAQGSHLASGSGPTSQVWCSLIIPLPEPLLPLPSTLFET

SEQ ID NO: 831308 - protein, 953 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAEIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSAMTEIVSRVSKRKLGRHVRALVLELCCNDESGEDVEVPYVRYTIPLTPSAPLGWPLVNPSPHPFQPAAKLKERLYQPMTEIVSRVSKRKLGPPRAGAGA

SEQ ID NO: 831309 - protein, 557 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQVISCGRRERGQASGQAAASPPPGPCLAFRCCMPKCKMCLFSKPPSLTSHQAA

SEQ ID NO: 831310 - protein, 484 aa, Homo sapiens
MTDPALTVSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPI

SEQ ID NO: 831311 - protein, 103 aa, Homo sapiens
GKEVAAPHSRADVLTLPCPAFSQPLHLDYVMAAANLFAQTYGLTGSQDRAAVATFLQSVQVPEFTPKSGVKIHVSDQELQSANASVGEGVWPVGQESPHMSPA

SEQ ID NO: 831312 - protein, 223 aa, Homo sapiens
MDFIVAASNLRAENYDIPSADRHKSKLIAGKIIPAIATTTAAVVGLVQYGKAKDSELTFPGGGGAISCLMEHHGKCGTQGLKDSIPKRWEQENATEFESCLAQGFLPAGRALSGPSGSPCLSGANCHWTHPSFIITSLGQQQQPGTSKELDNRGTRFGPSSEDRILRYSNSELVQGERRHPQRPQNQEVDASLLLHAVWEQREGLRHKSSNPHLPWRDPQITR

SEQ ID NO: 831313 - protein, 975 aa, Homo sapiens; identical to SEQ ID NO: 831296

SEQ ID NO: 831314 - protein, 818 aa, Homo sapiens
MKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831315 - protein, 789 aa, Homo sapiens
LGRGRAVNRQRFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831316 - protein, 615 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWATGTPSTRTTSGSCCTTSLLTSSQAQERRSGLGPNAVHTRSPLMSTIPCIWTM

SEQ ID NO: 831317 - protein, 416 aa, Homo sapiens
MTGNDCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831318 - protein, 351 aa, Homo sapiens
TIIFIGVNLTFFPPGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831319 - protein, 944 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADRLSGPSCCGHIPAVCAGPRIHPQVW

SEQ ID NO: 831320 - protein, 273 aa, Homo sapiens
MYPTDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSPGRVHALFLLHASCQAQGTVGSADDRDCEPCVEAKAGAATCGRWCLSCAVTTRAARMSRFPMSDTPSADPVCSSRLAPCPPLSTPLPAQGSHLASGSGPTSQVWCSLIIPLPEPLLPLPSTLFET

SEQ ID NO: 831321 - protein, 910 aa, Homo sapiens
MTDPALTVSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKAARMSRFPMSDTPSADPVCSSRLAPCPPLSTPLPAQGSHLASGSGPTSQVWCSLIIPLPEPLLPLPSTLFET

SEQ ID NO: 831322 - protein, 963 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKIEHGHAHGHAGRKGRSPEHLDACQSLCRSMSKSHKEHGVDTSQQDTEDGGRGAVSSQHSEEPFNVAERRWEGEARSCAIGNKTRRVDGTVLTSWHPDGPSTNLIPERPRPGTHGRMGRHEPAMR

SEQ ID NO: 831323 - protein, 868 aa, Homo sapiens; identical to SEQ ID NO: 831307

SEQ ID NO: 831324 - protein, 616 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSEASSFLGPIFFLQESAVTIV

SEQ ID NO: 831325 - protein, 485 aa, Homo sapiens
MTDPALTVSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSSVIRIR

SEQ ID NO: 831326 - protein, 378 aa, Homo sapiens
PLDGSRTDCSVTASLGGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAKLKERLDQPMTEIVSRVSKRKLGPPRAGAGA

SEQ ID NO: 831327 - protein, 78 aa, Homo sapiens
PAAQQGREPGPRRPSVPRPRKARRRQSEDPPGLKEKDEVIFGREGQASHPGTPGVQVLFEGIPPCKKHVFMVSSQQGQ

SEQ ID NO: 831328 - protein, 306 aa, Homo sapiens
PAPPPSNSRRLLCRFCRSLSDTFGSTSLILSFAGGRNQARAATMFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 831329 - protein, 269 aa, Homo sapiens
MQLSKVKFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 831330 - protein, 238 aa, Homo sapiens
MEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 831331 - protein, 238 aa, Homo sapiens; identical to SEQ ID NO: 831330

SEQ ID NO: 831332 - protein, 290 aa, Homo sapiens
MTARYEAWEVKSAEGFAGGRNQAAAATMFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 831333 - protein, 178 aa, Homo sapiens
PRVADAWVDPRVRLCRSLSDTFGSTSLILSFAGGRNQARAATMFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSSILFMLAFMDMNFEGFDTCVNY

SEQ ID NO: 831334 - protein, 176 aa, Homo sapiens
MRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 831335 - protein, 169 aa, Homo sapiens
PRVADAWVDPRVRLCRSLSDTFGSTSLILSFAGGRNQARAATMFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSRYGPSHFPNLSIC

SEQ ID NO: 831336 - protein, 105 aa, Homo sapiens
MSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 831337 - protein, 228 aa, Homo sapiens
PRVADAWVDPRVRLCRSLSDTFGSTSLILSFAGGRNQARAATMFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLMN

SEQ ID NO: 831338 - protein, 305 aa, Homo sapiens
PRVADAWVDPRVRLCRSLSDTFGSTSLILSFAGGRNQARAATMFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 831339 - protein, 306 aa, Homo sapiens; identical to SEQ ID NO: 831328

SEQ ID NO: 831340 - protein, 238 aa, Homo sapiens; identical to SEQ ID NO: 831330

SEQ ID NO: 831341 - protein, 178 aa, Homo sapiens; identical to SEQ ID NO: 831333

SEQ ID NO: 831342 - protein, 268 aa, Homo sapiens
PRVADAWVDPRVRLCRSLSDTFGSTSLILSFAGGRNQARAATMFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKPAQPADEPAEKADEPMEH

SEQ ID NO: 831343 - protein, 218 aa, Homo sapiens
PRVADAWVDPRVRLCRSLSDTFGSTSLILSFAGGRNQARAATMFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKQDLTTKNVSIGIVGKDLEFTIYDDDDVSPFLEGLEERPQRKAQPAQPADEPAEKADEPMEH

SEQ ID NO: 831344 - protein, 154 aa, Homo sapiens
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINRPQQTYCSGL

SEQ ID NO: 831345 - protein, 151 aa, Homo sapiens
PPKCVSLWRSVTGPPGGAEGNRGNERAGLGPGAVTRAGPESQDHGVGSGPVSASGSPARALAARAKLEEESEAGSTWDRGKAGPFPLLVRPRICERPGRESPREVQKGLGDLLIGVGRGSLGKEVAWGMTLSPPQQSEVMRLNDPAETLRV

SEQ ID NO: 831346 - protein, 355 aa, Homo sapiens
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 831347 - protein, 355 aa, Homo sapiens; identical to SEQ ID NO: 831346

SEQ ID NO: 831348 - protein, 355 aa, Homo sapiens; identical to SEQ ID NO: 831346

SEQ ID NO: 831349 - protein, 266 aa, Homo sapiens
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQVPRL

SEQ ID NO: 831350 - protein, 381 aa, Homo sapiens
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKILNPLYSEALCWGLGPSWEGKWPVLPLSLCRVLGRKALFPWNC

SEQ ID NO: 831351 - protein, 132 aa, Homo sapiens
RVGDVAASSLWSGFGGSKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 831352 - protein, 111 aa, Homo sapiens
IAVLEDHLDVLSQQYERVDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 831353 - protein, 355 aa, Homo sapiens; identical to SEQ ID NO: 831346

SEQ ID NO: 831354 - protein, 303 aa, Homo sapiens [sequence omitted]

SEQ ID NO: 831355 - protein, 266 aa, Homo sapiens; identical to SEQ ID NO: 831349

SEQ ID NO: 831356 - protein, 355 aa, Homo sapiens; identical to SEQ ID NO: 831346

SEQ ID NO: 831357 - protein, 355 aa, Homo sapiens; identical to SEQ ID NO: 831346

SEQ ID NO: 831358 - protein, 355 aa, Homo sapiens; identical to SEQ ID NO: 831346

SEQ ID NO: 831359 - protein, 355 aa, Homo sapiens; identical to SEQ ID NO: 831346

SEQ ID NO: 831360 - protein, 301 aa, Homo sapiens
MSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 831361 - protein, 259 aa, Homo sapiens
MAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 831362 - protein, 259 aa, Homo sapiens; identical to SEQ ID NO: 831361

SEQ ID NO: 831363 - protein, 321 aa, Homo sapiens
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQSVLLFPLLPALSPGSTRTC

SEQ ID NO: 831364 - protein, 155 aa, Homo sapiens
GIQTQSMWALNLLLTVKVCHILFSPPGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 831365 - protein, 355 aa, Homo sapiens; identical to SEQ ID NO: 831346

SEQ ID NO: 831366 - protein, 355 aa, Homo sapiens; identical to SEQ ID NO: 831346

SEQ ID NO: 831367 - protein, 205 aa, Homo sapiens
MDSRPNKPGFCVPVRNKRTPHNSPSWPNAASGNDLSKQHFRNAGRQRGQPSAQGASSLLTTDHKHADTFDEPHQSMHRNAGSITSPHARTKRDQAPRDTDEQPTAAAQQRPRPCRTHSNTKGEHCTHANGHHTLTDLQQVRTQPNTCTQQNGEARHPLNGTDKHWTLTTERPATGKQDTGAHTKTGTKNKEATQGPQSRETPTHS

SEQ ID NO: 831368 - protein, 481 aa, Homo sapiens
KEDINDKVGSALRQGFPSKMKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQSSIYSQTEEKAQGKSQKQITIPSQEQEHSQKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 831369 - protein, 142 aa, Homo sapiens
GRLLLLLNSRPRRQPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDQKKSRRGREFSSSSR

SEQ ID NO: 831370 - protein, 444 aa, Homo sapiens
KEDINDKVGSALRQGFPSKMKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQKDVSQSSIYSQTEEKAQGKSQKQITIPSQEQEHSQKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 831371 - protein, 481 aa, Homo sapiens; identical to SEQ ID NO: 831368

SEQ ID NO: 831372 - protein, 481 aa, Homo sapiens; identical to SEQ ID NO: 831368

SEQ ID NO: 831373 - protein, 481 aa, Homo sapiens; identical to SEQ ID NO: 831368

SEQ ID NO: 831374 - protein, 204 aa, Homo sapiens
KEDINDKVGSALRQGFPSKMKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGSNMDPKTFFLPKMSS

SEQ ID NO: 831375 - protein, 301 aa, Homo sapiens
KEDINDKVGSALRQGFPSKMKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRK

SEQ ID NO: 831376 - protein, 252 aa, Homo sapiens
KEDINDKVGSALRQGFPSKMKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSK

SEQ ID NO: 831377 - protein, 120 aa, Homo sapiens
GRLLLLLNSRPRRHIFSTQDELLVYNKNQHQTKNLNQDQQHGRKANKISYQSSSTEERRLHYGENGVQKDVSQSSIYSQTEEKAQGKSQKQITIPSQEQEHSQKAKKKSRRGREFSSSSR

SEQ ID NO: 831378 - protein, 421 aa, Homo sapiens
KEDINDKVGSALRQGFPSKMKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 831379 - protein, 481 aa, Homo sapiens; identical to SEQ ID NO: 831368

SEQ ID NO: 831380 - protein, 481 aa, Homo sapiens; identical to SEQ ID NO: 831368

SEQ ID NO: 831381 - protein, 421 aa, Homo sapiens; identical to SEQ ID NO: 831378

SEQ ID NO: 831382 - protein, 439 aa, Homo sapiens
GRLLLLLNSRPRRPQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQSSIYSQTEEKAQGKSQKQITIPSQEQEHSQKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 831383 - protein, 412 aa, Homo sapiens
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 831384 - protein, 232 aa, Homo sapiens
VVIPPQPPTTGPPRKEVPKTTPSEPKKKQPPPPESGPEQSKQKKVAPRPSIPVKQKPKEKEKPPPVNKQENAGTLNILSTLSNGNSSKKKFQQMESTGSEWTLKPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQKLEWWPVWIQAQGPRHSLLHSF

SEQ ID NO: 831385 - protein, 244 aa, Homo sapiens
MSTRPPMRPPGNVPAVLLGFQPALALTGALCLQQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKRGKPPEREPGINLVETRTHRGVKGEATGD

SEQ ID NO: 831386 - protein, 336 aa, Homo sapiens
MSNMENSFDDVSCLSPQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVDKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 831387 - protein, 412 aa, Homo sapiens; identical to SEQ ID NO: 831383

SEQ ID NO: 831388 - protein, 336 aa, Homo sapiens; identical to SEQ ID NO: 831386

SEQ ID NO: 831389 - protein, 336 aa, Homo sapiens
MSNMENSFDDVSCLSPQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 831390 - protein, 400 aa, Homo sapiens
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDGLSGVVGSRQLCGPRDRHEHIGKPYESGIF

SEQ ID NO: 831391 - protein, 419 aa, Homo sapiens
VVIPPQPPTTGPPRKEVPKTTPSEPKKKQPPPPESGPEQSKQKKVAPRPSIPVKQKPKEKEKPPPVNKQENAGTLNILSTLSNGNSSKKKFQQMESTGSEWTLKPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEWWPVWIQAQGPRHSLLHSF

SEQ ID NO: 831392 - protein, 336 aa, Homo sapiens; identical to SEQ ID NO: 831389

SEQ ID NO: 831393 - protein, 335 aa, Homo sapiens
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGKCWAPAWPGQCTQKERARG

SEQ ID NO: 831394 - protein, 336 aa, Homo sapiens; identical to SEQ ID NO: 831386

SEQ ID NO: 831395 - protein, 412 aa, Homo sapiens; identical to SEQ ID NO: 831383

SEQ ID NO: 831396 - protein, 158 aa, Homo sapiens
TCALKGCPSLTPAFPGLEPAEPQQGRRGVPGPCSPAPPGSARGGAGRGGTRRASWALAPPSGGHLGTGAAGVGASTLRSRQPSILGWPRGGGRAAPCSPETNARTGPPEAGSAGRNRSRFVLHLRKCLRAYSHSILVYQNEMQGTKNNIIEGSKSEIK

SEQ ID NO: 831397 - protein, 158 aa, Homo sapiens; identical to SEQ ID NO: 831396

SEQ ID NO: 831398 - protein, 158 aa, Homo sapiens; identical to SEQ ID NO: 831396

SEQ ID NO: 831399 - protein, 183 aa, Homo sapiens
TCALKGCPSLTPAFPGLEPAEPQQGRRGVPGPCSPAPPGSARGGAGRGGTRRASWALAPPSGGHLGTGAAGVGASTLRSRQPSILGWPRGGGRAAPCSPETNARTGPPEAGSAGRNRSRFVLHLRKCLRLQEENSVTRHEVKCQGKPLAGIHRKRMQHGARSPSTEDQRRQERTPRTFSKPKM

SEQ ID NO: 831400 - protein, 158 aa, Homo sapiens; identical to SEQ ID NO: 831396

SEQ ID NO: 831401 - protein, 483 aa, Homo sapiens
RSWWQLHWGDIANNSGNMKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 831402 - protein, 466 aa, Homo sapiens
MKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 831403 - protein, 477 aa, Homo sapiens
MRTWDYSNSGNMKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 831404 - protein, 422 aa, Homo sapiens [sequence omitted]

SEQ ID NO: 831405 - protein, 422 aa, Homo sapiens [sequence omitted]

SEQ ID NO: 831406 - protein, 436 aa, Homo sapiens
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 831407 - protein, 251 aa, Homo sapiens
MQNNGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 831408 - protein, 129 aa, Homo sapiens
EPHRLKEGPQHLIHLFWKRRSPPGASGAGHSGVNQLGGVFVNGRPLPDSTRQKIVELAHSGARPCDISRILQTHADAKVQVLDNQNVSNGCVSKILGRYYERLISPGVSVPVQVPGSEPDMSQYWPRLQ

SEQ ID NO: 831409 - protein, 422 aa, Homo sapiens [sequence omitted]

SEQ ID NO: 831410 - protein, 422 aa, Homo sapiens [sequence omitted]

SEQ ID NO: 831411 - protein, 474 aa, Homo sapiens
MHCGCLLLLSFFLFPFLLSFLFLFSLIFLFLFSLFFLFTLLSSLLFPFPLLSLSSGHSGVNQLGGVFVNGRPLPDSTRQKIVELAHSGARPCDISRILQVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 831412 - protein, 112 aa, Homo sapiens
MIRLVGRVPREEGAWGCGCVMCSSVTTGLPLSSQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 831413 - protein, 416 aa, Homo sapiens
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEFLAQLKIMDYSLLVGIHDVDRAEQEEMEVEERAEDEECENDGVGGNLLCSYGTPPDSPGNLLSFPRFFGPGEFDPSVDVYAMKSHESSPKKEVYFMAIIDILTPYDTKKKAAHAAKTVKHGAGAEISTVNPEQYSKRFNEFMSNILT

SEQ ID NO: 831414 - protein, 416 aa, Homo sapiens; identical to SEQ ID NO: 831413

SEQ ID NO: 831415 - protein, 409 aa, Homo sapiens
KEASDKEKAKDLPTFKDNDFLNEGQKLHVGEESKKNFLEKLKRDVEINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEFLAQLKIMDYSLLVGIHDVDRAEQEEMEVEERAEDEECENDGVGGNLLCSYGTPPDSPGNLLSFPRFFGPGEFDPSVDVYAMKSHESSPKKEVYFMAIIDILTPYDTKKKAAHAAKTVKHGAGAEISTVNPEQYSKRFNEFMSNILT

SEQ ID NO: 831416 - protein, 416 aa, Homo sapiens; identical to SEQ ID NO: 831413

SEQ ID NO: 831417 - protein, 416 aa, Homo sapiens; identical to SEQ ID NO: 831413

SEQ ID NO: 831418 - protein, 280 aa, Homo sapiens
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFHRSLLPLRRATVRGGGSQHPWGRGQYCSAHPSIRSDH

SEQ ID NO: 831419 - protein, 368 aa, Homo sapiens
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEFLAQLKIMDYSLLVGIHDVDRAEQEEMEVEERAEDEECENDGVGGNLLCSYGTPPDSPGNLLSFPRFFGPGEFDPSVDFSISHCSFHFLNGNFQSPVLV

SEQ ID NO: 831420 - protein, 244 aa, Homo sapiens
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKVKGSVFAGAVPPLYLSPEGATTPTSM

SEQ ID NO: 831421 - protein, 67 aa, Homo sapiens
KEASDKEKAKDLPTFKDNDFLNEGQKLHVGEESKKNFLEKLKRDVELTTLGTSHKRKQTAKRGGSCL

SEQ ID NO: 831422 - protein, 416 aa, Homo sapiens; identical to SEQ ID NO: 831413

SEQ ID NO: 831423 - protein, 316 aa, Homo sapiens [sequence omitted]

SEQ ID NO: 831424 - protein, 416 aa, Homo sapiens; identical to SEQ ID NO: 831413

SEQ ID NO: 831425 - protein, 416 aa, Homo sapiens; identical to SEQ ID NO: 831413

SEQ ID NO: 831426 - protein, 284 aa, Homo sapiens
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEVLTNLHFHLQGSFCT

SEQ ID NO: 831427 - protein, 224 aa, Homo sapiens
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLLGKQDKPPPHQVCDFSISHCSFHFLNGNFQSPVLV

SEQ ID NO: 831428 - protein, 1050 aa, Homo sapiens
WRRAACGRSGRASLKEHPRGTLLSDGSPALSRNVGMTVSQKGGPQPTPSPAGPGTQLGPITGEMDEADSAFLKFKQTADDSLSLTSPNTESIFVEDPYTASLRSEIESDGHEFEAESWSLAVDAAYAKKQKREVVKRQDVLYELMQTEVHHVRTLKIMLKVYSRALQEELQFSSKAIGRLFPCADDLLETHSHFLARLKERRQESLEEGSDRNYVIQKIGDLLVQQFSGENGERMKEKYGVFCSGHNEAVSHYKLLLQQNKKFQNLIKKIGNFSIVRRLGVQECILLVTQRITKYPVLVERIIQNTEAGTEDYEDLTQALNLIKDIISQVDAKVSECEKGQRLREIAGKMDLKSSSKLKNGLTFRKEDMLQRQLHLEGMLCWKTTSGRLKDILAILLTDVLLLLQEKDQKYVFASVDSKPPVISLQKLIVREVANEEKAMFLISASLQGPEMYEIYTSSKEDRNAWMAHIQRAVESCPDEEEGPFSLPEEERKVVEARATRLRDFQERLSMKDQLIAQSLLEKQQIYLEMAEMGGLEDLPQPRGLFRGGDPSETLQGELILKSAMSEIEGIQSLICRQLGSANGQAEDGGSSTGPPRRAETFAGYDCTNSPTKNGSFKKKVSSTDPRPRDWRGPPNSPDLKLSDSDIPGSSEESPQVVEAPGTESDPRLPTVLESELVQRIQTLSQLLLNLQAVIAHQDSYVETQRAAIQEREKQFRLQSTRGNLLLEQERQRNFEKQREERAALEKLQSQLRHEQQRWERERQWQHQELERAGARLQEREGEARQLRERLEQERAELERQRQAYQHDLERLREAQRAVERERERLELLRRLKKQNTAPGALPPDTLAEAQPPSHPPSFNGEGLEGPRVSMLPSGVGPEYAERPEVARRDSAPTENRLAKSDVPIQLLSATNQFQRQAAVQQQIPTKLAASTKGGKDKGGKSRGSQRWESSASFDLKQQLLLNKLMGKDESTSRNRRSLSPILPGRHSPAPPPDPGFPAPSPPPADSPSEGFSLKAGGTALLPGPPAPSPLPATPLSAKEDASKEDVIFF

SEQ ID NO: 831429 - protein, 997 aa, Homo sapiens
STNSVLASVTASLKEHPRGTLLSDGSPALSRNVGMTVSQKGGPQPTPSPAGPGTQLGPITGEMDEADSAFLKFKQTADDSLSLTSPNTESIFVEDPYTASLRSEIESDGHEFEAESWSLAVDAAYAKKQKREVVKRQDVLYELMQTEVHHVRTLKIMLKVYSRALQEELQFSSKAIGRLFPCADDLLETHSHFLARLKERRQESLEEGSDRNYVIQKIGDLLVQQFSGENGERMKEKYGVFCSGHNEAVSHYKLLLQQNKKFQNLIKKIGNFSIVRRLGVQECILLVTQRITKYPVLVERIIQNTEAGTEDYEDLTQALNLIKDIISQVDAKVSECEKGQRLREIAGKMDLKSSSKLKNGLTFRKEDMLQRQLHLEGMLCWKTTSGRLKDILAILLTDVLLLLQEKDQKYVFASVDSKPPVISLQKLIVREVANEEKAMFLISASLQGPEMYEIYTSSKEDRNAWMAHIQRAVESCPDEEEGPFSLPEEERKVVEARATRLRDFQERLSMKDQLIAQSLLEKQQIYLEMAEMGGLEDLPQPRARRAETFAGYDCTNSPTKNGSFKKKVSSTDPRPRDWRGPPNSPDLKLSDSDIPGSSEESPQVVEAPGTESDPRLPTVLESELVQRIQTLSQLLLNLQAVIAHQDSYVETQRAAIQEREKQFRLQSTRGNLLLEQERQRNFEKQREERAALEKLQSQLRHEQQRWERERQWQHQELERAGARLQEREGEARQLRERLEQERAELERQRQAYQHDLERLREAQRAVERERERLELLRRLKKQNTAPGALPPDTLAEAQPPSHPPSFNGEGLEGPRVSMLPSGVGPEYAERPEVARRDSAPTENRLAKSDVPIQLLSATNQFQRQAAVQQQIPTKLAASTKGGKDKGGKSRGSQRWESSASFDLKQQLLLNKLMGKDESTSRNRRSLSPILPGRHSPAPPPDPGFPAPSPPPADSPSEGFSLKAGGTALLPGPPAPSPLPATPLSAKEDASKEDVIFF

SEQ ID NO: 831430 - protein, 785 aa, Homo sapiens
MSSMKIGDLLVQQFSGENGERMKEKYGVFCSGHNEAVSHYKLLLQQNKKFQNLIKKIGNFSIVRRLGVQECILLVTQRITKYPVLVERIIQNTEAGTEDYEDLTQALNLIKDIISQVDAKVSECEKGQRLREIAGKMDLKSSSKLKNGLTFRKEDMLQRQLHLEGMLCWKTTSGRLKDILAILLTDVLLLLQEKDQKYVFASVDSKPPVISLQKLIVREVANEEKAMFLISASLQGPEMYEIYTSSKEDRNAWMAHIQRAVESCPDEEEGPFSLPEEERKVVEARATRLRDFQERLSMKDQLIAQSLLEKQQIYLEMAEMGGLEDLPQPRARRAETFAGYDCTNSPTKNGSFKKKVSSTDPRPRDWRGPPNSPDLKLSDSDIPGSSEESPQVVEAPGTESDPRLPTVLESELVQRIQTLSQLLLNLQAVIAHQDSYVETQRAAIQEREKQFRLQSTRGNLLLEQERQRNFEKQREERAALEKLQSQLRHEQQRWERERQWQHQELERAGARLQEREGEARQLRERLEQERAELERQRQAYQHDLERLREAQRAVERERERLELLRRLKKQNTAPGALPPDTLAEAQPPSHPPSFNGEGLEGPRVSMLPSGVGPEYAERPEVARRDSAPTENRLAKSDVPIQLLSATNQFQRQAAVQQQIPTKLAASTKGGKDKGGKSRGSQRWESSASFDLKQQLLLNKLMGKDESTSRNRRSLSPILPGRHSPAPPPDPGFPAPSPPPADSPSEGFSLKAGGTALLPGPPAPSPLPATPLSAKEDASKEDVIFF

SEQ ID NO: 831431 - protein, 997 aa, Homo sapiens; identical to SEQ ID NO: 831429

SEQ ID NO: 831432 - protein, 805 aa, Homo sapiens
MNRKCIFCLFCKEGYKERVILYVEESCIVNSLSKSKITLRRGSIEHVRKFSYVVDGLCKSSAQCMSVEVGGHSLALELLLSSMEAKNSKPGNGVVKLICLWILCVELLWSWLVVITYMNLPPSPLEFGQVQKALQYKNKILSFPTKEKIAPRFNQETYVLLKPKDRVKTGIPQESITMKWKGPYQVLLSTPTAVKLQGTPTWAHRSRTKPVSYESQAQRKGTTTTTNISKALEDLCYLFKIINTQPEEECNAVDGNRSIDLALLPDCEYFLSMALTSHLLLGNISCGLVGYRSYSKTQPDTMMPLLILFALLINLSKCVCGQGGWTKFYSKYFKNYSIIESSLWLPDLSSTPPGRQFHLPTYLENLRTMSPDLLTNHSTPKYPNPYCEVELFPTEWIPPGPCCPPALTTIIGIWEVGHLYLQCTHNSNICIHSCINDTKVEASLRCSGPTLLPSFQDHGEVNEIPFVSEEDHIWYLLPDGNIQRKNNCLIWEGDQYYLLLENKDCSTTTMRTGGKYLYRPNLAMKYKHRTPQASLGALVGFIFVCDYEWEEVTPCNHSNSLRSHLFFKEELSLVSKKLGTDMNERWPLLPLQGSQSITPRTQEYQKYVSNKTNSGRNQGGNRTSSTLGWLCLPGVNAKELGSNPRILSHQRRSGIKENSRVPQTLENVVVDNRLALDYLLAEQGGVIVQLLIKPAAHILTLDRLRLTFKRSMSKLPSYIDDNQGTAPNYIWSTIKSAFPSLTCFSPLLGPLTTVLLQMFGPCFFNLLVKFVYSRLPQFQRQCWHKASSPSCPLTRRMKSSCLWAP

SEQ ID NO: 831433 - protein, 150 aa, Homo sapiens
MKELLRLKHCKHLLTTHVHSPWTPSLTLTPSLLTLDTLTHPRHRHSSPWTPHSAPWTPSLTLDTFTHPDTLTHPGHPHSPWIPSLLTLDTLTHPGYPHSSPWTLSLTLTPSILTLDSLTPHPGLPHSSPWTPSLLILDTLTQPGHPHSSP

SEQ ID NO: 831434 - protein, 125 aa, Homo sapiens
MGTTRSIPRDSPLGCLLSYWSKFKFGLKKKKLILYCNTIWVKYKLDDEYIWPKHGSIYYSDILRLGLFCKREGKWEEIPYVQAFMALYWITLLPGIRMPCIRDPHLAAPHRKFISLPRVSSVPQS

SEQ ID NO: 831435 - protein, 150 aa, Homo sapiens; identical to SEQ ID NO: 831433

SEQ ID NO: 831436 - protein, 125 aa, Homo sapiens; identical to SEQ ID NO: 831434

SEQ ID NO: 831437 - protein, 225 aa, Homo sapiens
MDQQAIYAELNLPTDSGPESSSPSSLPRDVCQGSPWHQFALKLSCAGIILLVLVVTGLSVSVTSLIQKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDS

SEQ ID NO: 831438 - protein, 1581 aa, Homo sapiens
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 831439 - protein, 1032 aa, Homo sapiens
MADLENLSKLTGVCPQSNVQFDFLTVRENLRLFAKIKGILPQEVDKEIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 831440 - protein, 616 aa, Homo sapiens
TARIPRVDGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 831441 - protein, 404 aa, Homo sapiens
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLCWSLQWGQHFKNVTSSWAWWLMPIIPAL

SEQ ID NO: 831442 - protein, 266 aa, Homo sapiens
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFW

SEQ ID NO: 831443 - protein, 1417 aa, Homo sapiens
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMW

SEQ ID NO: 831444 - protein, 252 aa, Homo sapiens
ATLASPEPAAGGCDGPGADGGGRGGGVDARGAGWGITAGLDPEMALLAEHLLKPLPADKQIETGPFLEAVSHLPPFFDCLGSPVFTPIKADISGNITKIKAVYDTNPAKFRTLQNILEVEKEMYGAEWPKVGATLALMWLKRGLRFIQVFLQSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 831445 - protein, 233 aa, Homo sapiens
ATLASPEPAAGGCDGPGADGGGRGGGVDARGAGWGITAGLDPEMALLAEHLLKPLPADKQIETGPFLEAVSHLPPFFDCLGSPVFTPIKADISGNITKIKAVYDTNPAKFRTLQNILEVEKEIGLRFIQVFLQSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 831446 - protein, 358 aa, Homo sapiens
ATLASPEPAAGGCDGPGADGGGRGGGVDARGAGWGITAGLDPEMALLAEHLLKPLPADKQIETGPFLEAVSHLPPFFDCLGSPVFTPIKADISGNITMRKLRLRGVEGLAEGHKQVRGKAGIQTQAYLAPSQRPSFLDFLESSEPISTCPPKQNFRYLVSEAVSVVAGEHELCINCVTLGKSVLLCEPPVSLPVKWDNDSNIKKIKAVYDTNPAKFRTLQNILEVEKEMYGAEWPKVGATLALMWLKRGLRFIQVFLQSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 831447 - protein, 252 aa, Homo sapiens; identical to SEQ ID NO: 831444

SEQ ID NO: 831448 - protein, 365 aa, Homo sapiens
ATLASPEPAAGGCDGPGADGGGRGGGVDARGAGWGITAGLDPEMALLAEHLLKPLPADKQIETGPFLEAVSHLPPFFDCLGSPVFTPIKADISGNITMRKLRLRGVEGLAEGHKQVRGKAGIQTQAYLAPSQRPSFLDFLESSEPISTCPPKQNFRYLVSEAVSVVAGEHELCINCVTLGKSVLLCEPQCLCLENGIMTATSGLPPGSYKKIKAVYDTNPAKFRTLQNILEVEKEMYGAEWPKVGATLALMWLKRGLRFIQVFLQSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 831449 - protein, 222 aa, Homo sapiens
ATLASPEPAAGGCDGPGADGGGRGGGVDARGAGWGITAGLDPEMALLAEHLLKPLPADKQIETGPFLEAVSHLPPFFDCLGSPVFTPIKADISGNITKIKAVYDTNPAKFRTLQNILEVEKEMYGAEWPKVGATLALMWLKRGLRFIQVFLQSICDGERDENHPNLIRVNATKAYEMALKKYHGWIVQKIFQLLEMDSRSVSQAGVQWHDLGLLQPPPPEFQ

SEQ ID NO: 831450 - protein, 123 aa, Homo sapiens [sequence omitted]

SEQ ID NO: 831451 - protein, 406 aa, Homo sapiens
MATPGNLGSSVLASKTKTKKKHFVAQKVKLFRASDPLLSVLMWGVNHSINELSHVQIPVMLMPDDFKAYSKIKVDNHLFNKENMPSHFKFKEYCPMVFRNLRERFGIDDQDFQNSLTRSAPLPNDSQARSGARFHTSYDKRYIIKTITSEDVAEMHNILKKYHQYIVECHGITLLPQFLGMYRLNVDGVEIYVIVTRNVFSHRLSVYRKYDLKGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 831452 - protein, 168 aa, Homo sapiens
MLTRVKSAVANFMGGIMAGSSGSEHGGGSCGGSDLPLRFPYGRPEFLGLSQDEVECSADHIARPILILKETRRLPWATGYAEECSDTGGAPALLAALPRTVPALFSPCFSASGLSLAAGVQASAGSSLLTLAISLFSPLPLPPAQGRGVSSPGMGGGGVGGSAGAWES

SEQ ID NO: 831453 - protein, 514 aa, Homo sapiens
MLTRVKSAVANFMGGIMAGSSGSEHGGGSCGGSDLPLRFPYGRPEFLGLSQDEVECSADHIARPILILKETRRLPWATGYAEVINAGKSTHNEDQASCEVLTVKKKAGAVTSTPNRNSSKRRSSLPNGEGLQLKENSESEGVSCHYWSLFDGHAGSGAAVVASRLLQHHITEQLQDIVDILKNSAVLPPTCLGEEPENTPANSRTLTRAASLRGGVGAPGSPSTPPTRFFTEKKIPHECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRYTLAAQDLVMRARGVLKDRGWRISNDRLGSGDDISVYVIPLIHGNKLS

SEQ ID NO: 831454 - protein, 506 aa, Homo sapiens
MLTRVKSAVANFMGGIMAGSSGSEHGGGSCGGSDLPLRFPYGRPEFLGLSQDEVECSADHIARPILILKETRRLPWATGYAEVINAGKSTHNEDQASCEVLTVKKKAGAVTSTPNRNSSKRRSSLPNGEGLQLKENSESEGVSCHYWSLFDGHAGSGAAVVASRLLQHHITEQLQDIVDILKNSAVLPPTCLGEEPENTPANSRTLTRAASLRGGVGAPGSPSTPPTRFFTEKKIPHECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRFVHFYNCRVVPQAFFPGQAGMATPHGTPRELRPPGPEGCG

SEQ ID NO: 831455 - protein, 446 aa, Homo sapiens
MLTRVKSAVANFMGGIMAGSSGSEHGGGSCGGSDLPLRFPYGRPEFLGLSQDEVECSADHIARPILILKETRRLPWATGYAEVINAGKSTHNEDQASCEVLTVKKKAGAVTSTPNRNSSKRRSSLPNGEGLQLKENSESEGVSCHYWSLFDGLPQHAPHTLLYREEDSPECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRYTLAAQDLVMRARGVLKDRGWRISNDRLGSGDDISVYVIPLIHGNKLS

SEQ ID NO: 831456 - protein, 514 aa, Homo sapiens; identical to SEQ ID NO: 831453

SEQ ID NO: 831457 - protein, 715 aa, Homo sapiens
MPAESGKRFKPSKYVPVSAAAIFLVGATTLFFAFTCPGLSLYVSPAVPIYNAIMFLFVLANFSMATFMDPGIFPRAEEDEDKEDDFRAPLYKTVEIKGIQVRMKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNGSLSYDSLLTPSDSPDFESVQAGPEPDPPLGYTSPFLSARLAQQREAERHPRLVPTGPTHREPSPVRYDNLSRHIVASLQEREKLLRQSPPLPGREEEPGLGDSGIQSTPGSGHAPRTSSSSDDSKRSPLGKTPLGRPAVPRFGKPDGLRGRGVGSPEPGPTAPYLGRSMSYSSQKAQPGVSETEEVALQPLLTPKDEVQLKTTYSKSNGQPKSLGSASPGPGQPPLSSPTRGGVKKVSGVGGTTYEISV

SEQ ID NO: 831458 - protein, 662 aa, Homo sapiens
MFLFVLANFSMATFMDPGIFPRAEEDEDKEDDFRAPLYKTVEIKGIQVRMKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNGSLSYDSLLTPSDSPDFESVQAGPEPDPPLGYTSPFLSARLAQQREAERHPRLVPTGPTHREPSPVRYDNLSRHIVASLQEREKLLRQSPPLPGREEEPGLGDSGIQSTPGSGHAPRTSSSSDDSKRSPLGKTPLGRPAVPRFGKPDGLRGRGVGSPEPGPTAPYLGRSMSYSSQKAQPGVSETEEVALQPLLTPKDEVQLKTTYSKSNGQPKSLGSASPGPGQPPLSSPTRGGVKKVSGVGGTTYEISV

SEQ ID NO: 831459 - protein, 715 aa, Homo sapiens; identical to SEQ ID NO: 831457

SEQ ID NO: 831460 - protein, 169 aa, Homo sapiens
MDIEKNIIFFSEPLKLSPFPMFSVPFPDTYVLSLLSRDEVQLKTTYSKSNGQPKSLGSASPGPGQPPLSNGSLSYDSLLTPSDSPDFESVQAGLSQTHLYGYTSPFLSARLASNGKLRGTTFGANWPNTPRALTIRYDNLSRHIVDSSPTRGGVKKVSGVGGTTYEISV

SEQ ID NO: 831461 - protein, 396 aa, Homo sapiens [sequence omitted]

SEQ ID NO: 831462 - protein, 225 aa, Homo sapiens
MPAESGKRFKPSKYVPVSAAAIFLVGATTLFFAFTCPGLSLYVSPAVPIYNAIMFLFVLANFSMATFMDPGIFPRAEEDEDKEDDFRAPLYKTVEIKGIQVRMKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHIILITKEPTTNKPITNKF

SEQ ID NO: 831463 - protein, 613 aa, Homo sapiens
MKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNGSLSYDSLLTPSDSPDFESVQAGPEPDPPLGYTSPFLSARLAQQREAERHPRLVPTGPTHREPSPVRYDNLSRHIVASLQEREKLLRQSPPLPGREEEPGLGDSGIQSTPGSGHAPRTSSSSDDSKRSPLGKTPLGRPAVPRFGKPDGLRGRGVGSPEPGPTAPYLGRSMSYSSQKAQPGVSETEEVALQPLLTPKDEVQLKTTYSKSNGQPKSLGSASPGPGQPPLSSPTRGGVKKVSGVGGTTYEISV

SEQ ID NO: 831464 - protein, 715 aa, Homo sapiens; identical to SEQ ID NO: 831457

SEQ ID NO: 831465 - protein, 147 aa, Homo sapiens
MPAESGKRFKPSKYVPVSAAAIFLVGATTLFFAFTCPGLSLYVSPAVPIYNAIMFLFVLANFSMATFMDPGIFPRAEEDEDKEDDFRAPLYKTVEIKGIQVRMKWCATCRFYRPPRCSHCSVCDNCVEEFDHHCPWVNNCIGALRLG

SEQ ID NO: 831466 - protein, 725 aa, Homo sapiens
MPAESGKRFKPSKYVPVSAAAIFLVGATTLFFAFTCPGLSLYVSPAVPIYNAIMFLFVLANFSMATFMDPGIFPRAEEDEDKEDDFRAPLYKTVEIKGIQVRMKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNGSLSYDSLLTPSDSPDFESVQAGPEPDPPLGYTSPFLSARLAQQREAERHPRLVPTGPTHREPSPVRYDNLSRHIVASLQEREKLLRQSPPLPGREEEPGLGDSGIQSTPGSGHAPRTSSSSDDSKRSPLGKTPLGRPAVPRFGKPDGLRGRGVGSPEPGPTAPYLGRSMSYSSQKAQPGVSETEEVALQPLLTPKDEVQLKTTYSKSNGQPKSLGSASPGPGQPPLREGVAGLGPSDCPLGVTPQPTSLWCWVEGIPGF

SEQ ID NO: 831467 - protein, 110 aa, Homo sapiens
MQHWIPVHRQPESSNLQKTDPLEGTMPRKDQKLKVEQILRKNKKITHQTSHQLRQEVELEEFESCCTCCRTITILKPGLKNRLIQRSKRRKGMPSLCVLHKLHSSQQEIM

SEQ ID NO: 831468 - protein, 391 aa, Homo sapiens
MIEVVAELSRGPVFLAGEALECVVTVTNPLPPTATSASSEALAWASAQIHCQFHASESRVALPPPDSSQPDVQPDSQTVFLPHRGERGQCILSTPPKILFCDLRLDPGESKSYSYSEVLPIEGPPSFRGQSVKYVYKLTIGCQRVNSPITLLRVPLRVLVLTGLQDVRFPQDEAVAPSSPFLEEDEGGKKDSWLAELAGERLMAATSCRSLHLYNISDGRGKVGTFGIFKSVYRLGEDVVGTLNLGEGTVACLQFSVSLQTEERVQPEYQRRRGAGGVPSVSHVTHARHQESCLHTTRTSFSLPIPLSSTPGFCTAIVSLKWRLHFEFVTSREPGLVLLPPVEQPEPTTWTGPEQVPVDTFSWDLPIKVLPTSPTLASYAAPGPSTSTITI

SEQ ID NO: 831469 - protein, 391 aa, Homo sapiens; identical to SEQ ID NO: 831468

SEQ ID NO: 831470 - protein, 375 aa, Homo sapiens
MIEVVAELSRGPVFLAGEALECVVTVTNPLPPTATSASSEALAWASAQIHCQFHASESRVALPPPDSSQPDVQPDSQTVFLPHRGERGQCILSTPPKILFCDLRLDPGESKSYSYSEVLPIEGPPSFRGQSVKYVYKLTIGCQRVNSPITLLRVPLRVLVLTGLQDVRFPQDEAVAPSSPFLEEDEGGKKDSWLAELAGERLMAATSCRSLHLYNISDGRGKVGTFGIFKSVYRLGEDVVGTLNLGEGTVACLQFSVSLQTEERVQPEYQRRRGAGGVPSVSHVTHARHQESCLHTTRTSFSLPIPLSSTPGFCTAIVSLKWRLHFEFVTSREPGLVLLPPVEQPEPTTWTGPEQVPVDTFSWDLPIKLEEAWVF

SEQ ID NO: 831471 - protein, 391 aa, Homo sapiens; identical to SEQ ID NO: 831468

SEQ ID NO: 831472 - protein, 391 aa, Homo sapiens; identical to SEQ ID NO: 831468

SEQ ID NO: 831473 - protein, 391 aa, Homo sapiens; identical to SEQ ID NO: 831468

SEQ ID NO: 831474 - protein, 391 aa, Homo sapiens; identical to SEQ ID NO: 831468

SEQ ID NO: 831475 - protein, 118 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKRWKPG

SEQ ID NO: 831476 - protein, 108 aa, Homo sapiens [sequence omitted]

SEQ ID NO: 831477 - protein, 224 aa, Homo sapiens [sequence omitted]

SEQ ID NO: 831478 - protein, 235 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 831479 - protein, 145 aa, Homo sapiens
MDQASRAMIENFNAKYVSLHVRKSNRAALHLYSNTLNFQISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 831480 - protein, 220 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKRISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 831481 - protein, 154 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQSVKWSPNTMQMRCTSSAPALPPPPK

SEQ ID NO: 831482 - protein, 235 aa, Homo sapiens; identical to SEQ ID NO: 831478

SEQ ID NO: 831483 - protein, 235 aa, Homo sapiens; identical to SEQ ID NO: 831478

SEQ ID NO: 831484 - protein, 101 aa, Homo sapiens
PEGPGRARPGGPECACGRWTYGAGPARRRGRGAGPGLRFPPVCVMSGLRWVGSGDLRGAHSCSCAPGVVQSQIVTVPAQPRGRGAEQTDGEQASHPWSPPP

SEQ ID NO: 831485 - protein, 93 aa, Homo sapiens
RVQTVLRVQTVPRVQTVPRVQTVPENFNAKYVSLHVRKSNRAALHLYSNTLNFQISEVEPKYYADGEDAYAMKRDLTQMADEWPTQLFSQGQW

SEQ ID NO: 831486 - protein, 235 aa, Homo sapiens; identical to SEQ ID NO: 831478

SEQ ID NO: 831487 - protein, 235 aa, Homo sapiens; identical to SEQ ID NO: 831478

SEQ ID NO: 831488 - protein, 245 aa, Homo sapiens
LVDPPGWQEFGTSRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 831489 - protein, 118 aa, Homo sapiens; identical to SEQ ID NO: 831475

SEQ ID NO: 831490 - protein, 220 aa, Homo sapiens
MAVVRQLSKGQGAGQGGKGKAEFRASAHKKPQKWILSIQAKDTERGQDGWGGPLCPGAFAGENRGQVTLDLLSQDGAFREKTWHLAPVATIPGVEEGVPGIQVFLLALQPSAPRISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 831491 - protein, 136 aa, Homo sapiens
MEPFSCDTFVALPPATVDNRIIFGKNSDRLYDEVQEVVYFPAVVHDNLGERLKCTYIEIDQVPETYAVVLSRPVLNDGIKTRSLVLVERRKAQSGTLGRAMMMYLASGPRQLMAEASRGLARKGQIRDLENEQERR

SEQ ID NO: 831492 - protein, 424 aa, Homo sapiens
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGKKEFDFAAAYSYLDTAKMMTSSGRYCEGYKLLNKHKGNITFETMMEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSVKVSS

SEQ ID NO: 831493 - protein, 444 aa, Homo sapiens
MTDSSARTEALSILYPALKKMEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGKKEFDFAAAYSYLDTAKMMTSSGRYCEGYKLLNKHKGNITFETMMEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSVKVSS

SEQ ID NO: 831494 - protein, 424 aa, Homo sapiens; identical to SEQ ID NO: 831492

SEQ ID NO: 831495 - protein, 424 aa, Homo sapiens; identical to SEQ ID NO: 831492

SEQ ID NO: 831496 - protein, 165 aa, Homo sapiens
MEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSVKVSS

SEQ ID NO: 831497 - protein, 166 aa, Homo sapiens [sequence omitted]

SEQ ID NO: 831498 - protein, 344 aa, Homo sapiens
MGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGKKEFDFAAAYSYLDTAKMMTSSGRYCEGYKLLNKHKGNITFETMMEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSVKVSS

SEQ ID NO: 831499 - protein, 165 aa, Homo sapiens; identical to SEQ ID NO: 831496

SEQ ID NO: 831500 - protein, 165 aa, Homo sapiens; identical to SEQ ID NO: 831496

SEQ ID NO: 831501 - protein, 180 aa, Homo sapiens
MASTISAYKEKMKELSVLSLICSCFYTQPHPNTVYQYGDMEVKQLDKRASGQSFEVILKSPSDLSPESPMLSSPPKKKDTSLEELQKRLEAAEERRKTQEAQVLKQLAERREHEREVLHKALEENNNFSRQAEEKLNYKMELSKEIREAHLAALRERLREKELHAAEVRRNKEQREEMSG

SEQ ID NO: 831502 - protein, 202 aa, Homo sapiens
MSVGRHRVVNSATGLRCVDSALGWPIVLTYKEKMKELSVLSLICSCFYTQPHPNTVYQYGDMEVKQLDKRASGQSFEVILKSPSDLSPESPMLSSPPKKKDTSLEELQKRLEAAEERRKTQEAQVLKQLAERREHEREVLHKALEENNNFSRQAEEKLNYKMELSKEIREAHLAALRERLREKELHAAEVRRNKEQREEMSG

SEQ ID NO: 831503 - protein, 218 aa, Homo sapiens [sequence omitted]

SEQ ID NO: 831504 - protein, 138 aa, Homo sapiens
AGRRRMEKQVSVEDETDINAEREEKRGEAEGERDRRQGTHHGDSADVWKREELERRRGRRCGDTQESVLGSSVSHRDMIEAAMGRENGGPGGQAPVVLAQPSLVPTAYKEKMKELSVLSLICSCFYTQPHPNTVYQYG

SEQ ID NO: 831505 - protein, 180 aa, Homo sapiens; identical to SEQ ID NO: 831501

SEQ ID NO: 831506 - protein, 218 aa, Homo sapiens [sequence omitted]

SEQ ID NO: 831507 - protein, 218 aa, Homo sapiens [sequence omitted]

SEQ ID NO: 831508 - protein, 176 aa, Homo sapiens
MCNIKIHETQPLLNLKLDRVMQDIVYKLVPGLQDSEEKRIREFYQSRGLDRVTQPTGEEPALSNLGLPFSSFDHSKAHYYRYDEQLNLCLERLSSGKDKNKSVLQNKYVRCSVRAEVRHLRRVLCHRLMLNPQHVQLLFDNEVLPDHMTMKQIWLSRWFGKPSPLLLQYSVKEKRR

SEQ ID NO: 831509 - protein, 259 aa, Homo sapiens
MASPQGGQIAIAMRLRNQLQSVYKMDPLRNEEEVRVKIKDLNEHIVCCLCAGYFVDATTITECLHTFCKSCIVKYLQTSKYCPMCNIKIHETQPLLNLKLDRVMQDIVYKLVPGLQDSEEKRIREFYQSRGLDRVTQPTGEEPALSNLGLPFSSFDHSKAHYYRYDEQLNLCLERLSSGKDKNKSVLQNKYVRCSVRAEVRHLRRVLCHRLMLNPQHVQLLFDNEVLPDHMTMKQIWLSRWFGKPSPLLLQYSVKEKRR

SEQ ID NO: 831510 - protein, 92 aa, Homo sapiens
CAYYYQTRPAGCRYYFVDATTITECLHTCECLGDCLVLPVPSLHQADCQLLCGLPHASRHPTQPMNPVSRGPENLLFFSCSLQELYCEVPPN

SEQ ID NO: 831511 - protein, 176 aa, Homo sapiens; identical to SEQ ID NO: 831508

SEQ ID NO: 831512 - protein, 258 aa, Homo sapiens
GSGRLGSAFKMASPQGGQIAIAMRLRNQLQSVYKMDPLRNEEEVRVKIKDLNEHIVCCLCAGYFVDATTITECLHTFCKSCIVKYLQTSKYCPMCNIKIHETQPLLNLKLDRVMQDIVYKLVPGLQDSEEKRIREFYQSRGLDRVTQPTGEEPALSNLGLPFSSFDHSKAHYYRYDEQLNLCLERLSSGKDKNKSVLQNKYVRCSVRAEVRHLRRVLCHRLMLNPQHVQLLFDNEVLPDHMTMKQIWLSRWFGKPSLG

SEQ ID NO: 831513 - protein, 176 aa, Homo sapiens; identical to SEQ ID NO: 831508

SEQ ID NO: 831514 - protein, 142 aa, Homo sapiens
MCNIKIHETQPLLNLKLDRVMQDIVYKLVPGLQDSEEKRIREFYQSRGLDRVTQPTGEEPALSNLGLPFSSFDHSKAHYYRYDEQLNLCLERLSSGKDKNKSVLQNKYVRCSVRAEVRHLRRVLCHRLMLNPQHGASSFFDN

SEQ ID NO: 831515 - protein, 106 aa, Homo sapiens
MCNIKIHETQPLLNLKLDRVMQDIVYKLVPGLQDSEEKRIREFYQSRGLDRVTQPTGEEPALSNLGLPFSSFDHSKAHYYRYDEQLNLCLERLSSGKDKNKSVLQS

SEQ ID NO: 831516 - protein, 375 aa, Homo sapiens [sequence omitted]

SEQ ID NO: 831517 - protein, 433 aa, Homo sapiens
MVVFLSGDNLSSPSHSGIIWQCLETFWVLTNRRRMPLASSRSAMLLSILQCPGQPHKDSSSLNVNSAEVEEPYFTGTRQEESVCPRTLVIITCPLQYSTTQRQCFLGNGFFSLQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFPESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 831518 - protein, 203 aa, Homo sapiens
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKMKGLSIIFNIASLACLAYSMIEKGMLEKR

SEQ ID NO: 831519 - protein, 375 aa, Homo sapiens [sequence omitted]

SEQ ID NO: 831520 - protein, 2235 aa, Homo sapiens
LEFKISDEEADDADAAGRDSPSNTSQSEQQESVDAEGPVVEKIMSSRSVKKQKESGEEVEIEEFYVKYKNFSYLHCQWASIEDLEKDKRIQQKIKRFKAKQGQNKFLSEIEDELFNPDYVEVDRIMDFARSTDDRGEPVTHYLVKWCSLPYEDSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLEHKVLLTGTPLQNTVEELFSLLHFLEPSRFPSETTFMQEFGDLKTEEQVQKLQAILKPMMLRRLKEDVEKNLAPKEETIIEVELTNIQKKYYRAILEKNFTFLSKGGGQANVPNLLNTMMELRKCCNHPYLINGAEEKILEEFKETHNAESPDFQLQAMIQAAGKLVLIDKLLPKLKAGGHRVLIFSQMVRCLDILEDYLIQRRYPYERIDGRVRGNLRQAAIDRFSKPDSDRFVFLLCTRAGGLGINLTAADTCIIFDSDWNPQNDLQAQARCHRIGQSKSVKIYRLITRNSYEREMFDKASLKLGLDKAVLQSMSGRENATNGVQQLSKKEIEDLLRKGAYGALMDEEDEGSKFCEEDIDQILLRRTHTITIESEGKGSTFAKASFVASGNRTDISLDDPNFWQKWAKKAELDIDALNGRNNLVIDTPRVRKQTRLYSAVKEDELMEFSDLESDSEEKPCAKPRRPQDKSQGYARSECFRVEKNLLVYGWGRWTDILSHGRYKRQLTEQDVETICRTILVYCLNHYKGDENIKSFIWDLITPTADGQTRALVNHSGLSAPVPRGRKGKKVKAQSTQPVVQDADWLASCNPDALFQEDSYKKHLKHHCNKVLLRVRMLYYLRQEVIGDQADKILEGADSSEADVWIPEPFHAEVPADWWDKEADKSLLIGVFKHGYEKYNSMRADPALCFLERVGMPDAKAIAAEQRGTDMLADGGDGGEFDREDEDPEYKPTRTPFKDEIDEFANSPSEDKEESMEIHATGKHSESNAELGQLYWPNTSTLTTRLRRLITAYQRSYKRQQMRQEALMKTDRRRRRPREEVRALEAEREAIISEKRQKWTRREEADFYRVVSTFGVIFDPVKQQFDWNQFRAFARLDKKSDESLEKYFSCFVAMCRRVCRMPVKPDDEPPDLSSIIEPITEERASRTLYRIELLRKIREQVLHHPQLGERLKLCQPSLDLPEWWECGRHDRDLLVGAAKHGVSRTDYHILNDPELSFLDAHKNFAQNRGAGNTSSLNPLAVGFVQTPPVISSAHIQDERVLEQAEGKVEEPENPAAKEKCEGKEEEEETDGSGKESKQECEAEASSVKNELKGVEVGADTGSKSISEKGSEEDEEEKLEDDDKSEESSQPEAGAVSRGKNFDEESNASMSTARDETRDGFYMEDGDPSVAQLLHERTFAFSFWPKDRVMINRLDNICEAVLKGKWPVNRRQMFDFQGLIPGYTPTTVDSPLQKRSFAELSMVGQASISGSEDITTSPQLSKEDALNLSVPRQRRRRRRKIEIEAERAAKRRNLMEMVAQLRESQVVSENGQEKVVDLSKASREATSSTSNFSSLSSKFILPNVSTPVSDAFKTQMELLQAGLSRTPTRHLLNGSLVDGEPPMKRRRGRRKNVEGLDLLFMSHKRTSLSAEDAEVTKAFEEDIETPPTRNIPSPGQLDPDTRIPVINLEDGTRLVGEDAPKNKDLVEWLKLHPTYTVDMPSYVPKNADVLFSSFQKPKQKRHRCRNPNKLDINTLTGEERVPVVNKRNGKKMGGAMAPPMKDLPRWLEENPEFAVAPDWTDIVKQSGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 831521 - protein, 877 aa, Homo sapiens
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWMGGAMAPPMKDLPRWLEENPEFAVAPDWTDIVKQSGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 831522 - protein, 904 aa, Homo sapiens
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWMGGAMAPPMKDLPRWLEENPEFAVAPDWTDIVKQSVHHRGSHGDQVVFDSLYKPLFASPVLQGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 831523 - protein, 877 aa, Homo sapiens; identical to SEQ ID NO: 831521

SEQ ID NO: 831524 - protein, 159 aa, Homo sapiens
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQACPRHQGN

SEQ ID NO: 831525 - protein, 1911 aa, Homo sapiens
LEFKISDEEADDADAAGRDSPSNTSQSEQQESVDAEGPVVEKIMSSRSVKKQKESGEEVEIEEFYVKYKNFSYLHCQWASIEDLEKDKRIQQKIKRFKAKQGQNKFLSEIEDELFNPDYVEVDRIMDFARSTDDRGEPVTHYLVKWCSLPYEDSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLEHKVLLTGTPLQNTVEELFSLLHFLEPSRFPSETTFMQEFGDLKTEEQVQKLQAILKPMMLRRLKEDVEKNLAPKEETIIEVELTNIQKKYYRAILEKNFTFLSKGGGQANVPNLLNTMMELRKCCNHPYLINGAEEKILEEFKETHNAESPDFQLQAMIQAAGKLVLIDKLLPKLKAGGHRVLIFSQMVRCLDILEDYLIQRRYPYERIDGRVRGNLRQAAIDRFSKPDSDRFVFLLCTRAGGLGINLTAADTCIIFDSDWNPQNDLQAQARCHRIGQSKSVKIYRLITRNSYEREMFDKASLKLGLDKAVLQSMSGRENATNGVQQLSKKEIEDLLRKGAYGALMDEEDEGSKFCEEDIDQILLRRTHTITIESEGKGSTFAKASFVASGNRTDISLDDPNFWQKWAKKAELDIDALNGRNNLVIDTPRVRKQTRLYSAVKEDELMEFSDLESDSEEKPCAKPRRPQDKSQGYARSECFRVEKNLLVYGWGRWTDILSHGRYKRQLTEQDVETICRTILVYCLNHYKGDENIKSFIWDLITPTADGQTRALVNHSGLSAPVPRGRKGKKVKAQSTQPVVQDADWLASCNPDALFQEDSYKKHLKHHCNKVLLRVRMLYYLRQEVIGDQADKILEGADSSEADVWIPEPFHAEVPADWWDKEADKSLLIGVFKHGYEKYNSMRADPALCFLERVGMPDAKAIAAEQRGTDMLADGGDGGEFDREDEDPEYKPTRTPFKDEIDEFANSPSEDKEESMEIHATGKHSESNAELGQLYWPNTSTLTTRLRRLITAYQRSYKRQQMRQEALMKTDRRRRRPREEVRALEAEREAIISEKRQKWTRREEADFYRVVSTFGVIFDPVKQQFDWNQFRAFARLDKKSDESLEKYFSCFVAMCRRVCRMPVKPDDEPPDLSSIIEPITEERASRTLYRIELLRKIREQVLHHPQLGERLKLCQPSLDLPEWWECGRHDRDLLVGAAKHGVSRTDYHILNDPELSFLDAHKNFAQNRGAGNTSSLNPLAVGFVQTPPVISSAHIQDERVLEQAEGKVEEPENPAAKEKCEGKEEEEETDGSGKESKQECEAEASSVKNELKGVEVGADTGSKSISEKGSEEDEEEKLEDDDKSEESSQPEAGAVSRGKNFDEESNASMSTARDETRDGFYMEDGDPSVAQLLHERTFAFSFWPKDRVMINRLDNICEAVLKGKWPVNRRQMFDFQGLIPGYTPTTVDSPLQKRSFAELSMVGQASISGSEDITTSPQLSKEDALNLSVPRQRRRRRRKIEIEAERAAKRRNLMEMVAQLRESQVVSENGQEKVVDLSKASREATSSTSNFSSLSSKFILPNVSTPVSDAFKTQMELLQAGLSRTPTRHLLNGSLVDGEPPMKRRRGRRKNVEGLDLLFMSHKRTSLSAEDAEVTKAFEEDIETPPTRNIPSPGQLDPDTRIPVINLEDGTRLVGEDAPKNKDLVEWLKLHPTYTVDMPSYVPVSIAEFRVGRNLAGRSTSFPYNIEIPDSWSLCLFLECFLVSNISQVFVVESSSLQILASGLSY

SEQ ID NO: 831526 - protein, 627 aa, Homo sapiens
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQVSGPNAQLVKSDDYLPSIEQQPQQKKKKKKNNHIVAEDPSKGFGKDDFPGGVDNQ

SEQ ID NO: 831527 - protein, 2235 aa, Homo sapiens; identical to SEQ ID NO: 831520

SEQ ID NO: 831528 - protein, 877 aa, Homo sapiens; identical to SEQ ID NO: 831521

SEQ ID NO: 831529 - protein, 841 aa, Homo sapiens
MGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWMGGAMAPPMKDLPRWLEENPEFAVAPDWTDIVKQSGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 831530 - protein, 243 aa, Homo sapiens
VALEVPGRLSTPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQVSGPNAQLVKSDDYLPSIEQQPQQKKKKKKNNHIVAEDPSKGFGKDDFPGGVDN

SEQ ID NO: 831531 - protein, 104 aa, Homo sapiens
LGGRAPPLAPPNPRASLGGEGEPGSCERAGERSCRRWGGRSRGAGAERGCGRSGRLRQRRRLSVIVPGSRQQFLYLRRGSERSLCRTRSKERKQSKFFFIKSTV

SEQ ID NO: 831532 - protein, 70 aa, Homo sapiens
LEGRAPPLAPPNPRASLGGEGEPGSCERAGERSCRRWGGRSRGAGAERGCGRSGRLRQRRRKGDGGLTEV

SEQ ID NO: 831533 - protein, 103 aa, Homo sapiens
KNLGNIHSTVKDTVEGQAVQSVINGSFTKSKENALQRKKILKKSLLKFQKICFYIYTFSLHSPSRTFCSEDSHIQLWEIIISLIIPSTFEDYQISQQQYCGLE

SEQ ID NO: 831534 - protein, 368 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 831535 - protein, 368 aa, Homo sapiens; identical to SEQ ID NO: 831534

SEQ ID NO: 831536 - protein, 333 aa, Homo sapiens
MNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 831537 - protein, 368 aa, Homo sapiens; identical to SEQ ID NO: 831534

SEQ ID NO: 831538 - protein, 516 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITASPWLPRVQVGARPGPHHMFPWPQSCPCSPTTATQRHPMKLFSRSLPNPSVQGSSPRRTVPGSAARRRSIRMGTVGSARAAAPVQTHMFCSSSSCISSLSTLPDSAAPLSPLASSWPVPPRPLLHWPFDQSSLLFSLSPSFLSLSLSLSLSFCVCVCVCVCVCVCVLCFLRPFSLLSLVACSLHLSEPGFACPFHSTPSGLLP

SEQ ID NO: 831539 - protein, 265 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYSSGEHSQTS

SEQ ID NO: 831540 - protein, 368 aa, Homo sapiens; identical to SEQ ID NO: 831534

SEQ ID NO: 831541 - protein, 103 aa, Homo sapiens
CLEITRGPPPSMDSRPRRRDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 831542 - protein, 248 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISELPLLSHHSHPEAPHEAFFSFTPKPKCPRLQS

SEQ ID NO: 831543 - protein, 368 aa, Homo sapiens; identical to SEQ ID NO: 831534

SEQ ID NO: 831544 - protein, 174 aa, Homo sapiens
REKKDGERENRREDWSKANPSVQGSSPRRTVPGSAARRRSIRMGTVGSARAAAPVQTHMFCSSSSCISSLSTLPDSAAPLSPLASSWPVPPRPLLHWPFDQSSLLFSLSPSFLSLSLSLSLSFCVCVCVCVCVCVCVLCFLRPFSLLSLVACSLHLSEPGFACPFHSTPSGLLP

SEQ ID NO: 831545 - protein, 338 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYSGPTVLCHRHLTASHQQTVVPSDVDSPRRYPSWTQPLDSDPDSWPSLQGACHLLRDSSSSPSRRDLLCSCLHSFPGFKCAWH

SEQ ID NO: 831546 - protein, 235 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELH

SEQ ID NO: 831547 - protein, 162 aa, Homo sapiens
TVDADGIIATKSQTSYRNAEFSPGKKCARICEFMCVCVCVCVCVCLVLPQTFLASELGGLFPPSLRTWLRLSLSLHTLWPSALSWDCFLSVRPAPSPCPQNPRDSGLPSLPCSGLAPKPVLSRRRLGGGGPASRADDTINRQSPRHTPVFLEAPHPHWPTGG

SEQ ID NO: 831548 - protein, 219 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGREPTWKTMAFPWNPSNGPEANYPGAIFK

SEQ ID NO: 831549 - protein, 368 aa, Homo sapiens; identical to SEQ ID NO: 831534

SEQ ID NO: 831550 - protein, 368 aa, Homo sapiens; identical to SEQ ID NO: 831534

SEQ ID NO: 831551 - protein, 368 aa, Homo sapiens; identical to SEQ ID NO: 831534

SEQ ID NO: 831552 - protein, 368 aa, Homo sapiens; identical to SEQ ID NO: 831534

SEQ ID NO: 831553 - protein, 368 aa, Homo sapiens; identical to SEQ ID NO: 831534

SEQ ID NO: 831554 - protein, 385 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYVRSWEEPAGLQQRAGVRALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 831555 - protein, 368 aa, Homo sapiens; identical to SEQ ID NO: 831534

SEQ ID NO: 831556 - protein, 368 aa, Homo sapiens; identical to SEQ ID NO: 831534

SEQ ID NO: 831557 - protein, 265 aa, Homo sapiens; identical to SEQ ID NO: 831539

SEQ ID NO: 831558 - protein, 189 aa, Homo sapiens
ARPPRELIPRLCGSPQPPCKFMACPSQTPAPLALRPVLPSVLSFPVLPLSLSLSLSLFLCVCVCVCVCVCVCLVLPQTFLASELGGLFPPSLRTWLRLSLSLHTLWPSALSWDCFLSVRPAPSPCPQNPRDSGLPSLPCSGLAPKPVLSRRRLGGGGPASRADDTINRQSPRHTPVFLEAPHPHWPTGG

SEQ ID NO: 831559 - protein, 251 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKELLKPYESTIPKKSGLQMGTWFLSQA

SEQ ID NO: 831560 - protein, 258 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQKKKKKKKFWGGWGEKRFFTPLLVGRAAAPAGNAAHGAPRRPKEDTVRLEDAGEFSPPKKKGAGGSEVHGHIPEGAGRLHGSNHRSSGRYPRAGRGGKTQTTHNTHKQPTTRPHADNSEHSN

SEQ ID NO: 831561 - protein, 1005 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKKNSLRVEGDNIYVRHSNLMLEELDKAQEDILKHQASISELKRNFMESTPEPRPNEWEKRRITPLSLQTQGSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831562 - protein, 1005 aa, Homo sapiens; identical to SEQ ID NO: 831561

SEQ ID NO: 831563 - protein, 1079 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKKNSLRVEGDNIYVRHSNLMLEELDKAQEDILKHQASISELKRNFMESTPEPRPNEWEKRRITPLSLQTQGSLEEEITSILFSEKGFSDSMKATFTSATTWTAEGAVVSANAPSEKLSSSPFSHLLETRAPESEGPCTGARDAVKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831564 - protein, 870 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831565 - protein, 647 aa, Homo sapiens
AFGRWISISFPQFSNDKEIADSGLDVLKSCKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831566 - protein, 574 aa, Homo sapiens
FDLVALRRPSALRRPSALRRPSALRRPSALRRPSALRRPSALRRPSALRRPFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831567 - protein, 214 aa, Homo sapiens
MNGKEISPGSGPGEIRKVEPVTQKDSTSLSSESSSSSSESEEEDVGEYRPHHRVTEGTIREEQEYEEEVEEEPRPAAKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831568 - protein, 381 aa, Homo sapiens
CLKQERKGDHLFKDILSVKEKYLMPTIWTVEEKAQETDKTRAPESEGPCTGARDAVKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831569 - protein, 1005 aa, Homo sapiens; identical to SEQ ID NO: 831561

SEQ ID NO: 831570 - protein, 271 aa, Homo sapiens
AKMEEEETQLEEELDKAQEDILKHQASISELKRNFMESTPEPRPNEWEKRRITPLSLQTQGSLEEEITSILFSEKGFSDSMKATFTSATTWTAEGAVVSANAPSEKLSSSPFSHLLETRAPESEGPCTGARDAVKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831571 - protein, 1005 aa, Homo sapiens; identical to SEQ ID NO: 831561

SEQ ID NO: 831572 - protein, 771 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPQKVNGEVSHVDIDVLPQIICCSEVNGSPRWEPNSRAASQMGNSCLSSPVLPVLQLFSTRI

SEQ ID NO: 831573 - protein, 479 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELVTRKLYHLKLAPETR

SEQ ID NO: 831574 - protein, 110 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGELLLCIKPLCLHM

SEQ ID NO: 831575 - protein, 173 aa, Homo sapiens [sequence omitted]

SEQ ID NO: 831576 - protein, 1005 aa, Homo sapiens; identical to SEQ ID NO: 831561

SEQ ID NO: 831577 - protein, 1005 aa, Homo sapiens; identical to SEQ ID NO: 831561

SEQ ID NO: 831578 - protein, 1005 aa, Homo sapiens; identical to SEQ ID NO: 831561

SEQ ID NO: 831579 - protein, 852 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831580 - protein, 1072 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKKNSLRVEGDNIYVRHSNLMLEELDKAQEDILKHQASISELKRNFMESTPEPRPNEWEKRRITPLSLQTQGSLEEEITSILFSEKGFSDSMKATFTSATTWTAEGAVVSANAPSEKLSSSPFSHLLETRAPESEGPCTGARDAVKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831581 - protein, 267 aa, Homo sapiens
MESTPEPRPNEWEKRRITPLSLQTQGSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831582 - protein, 296 aa, Homo sapiens
MKATFTSATTWTAEGAVVSANAPSEKLSSSPFSHLLETRAPESEGPCTGARDAVKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 831583 - protein, 948 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKKNSLRVEGDNIYVRHSNLMLEELDKAQEDILKHQASISELKRNFMESTPEPRPNEWEKRRITPLSLQTQGSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKSRSLS

SEQ ID NO: 831584 - protein, 1005 aa, Homo sapiens; identical to SEQ ID NO: 831561

SEQ ID NO: 831585 - protein, 1005 aa, Homo sapiens; identical to SEQ ID NO: 831561

SEQ ID NO: 831586 - protein, 785 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKKNSLRVEGDNIYVRHSNLMLEELDKAQEDILKHQASISELKRNFMESTPEPRPNEWEKRRITPLSLQTQGSLEEEITSILFSEKGFSDSMKATFTSATTWTAEGAVVSANAPSEKLSSSPFSHLLEVHFTLFPLLLKATYERDFHFFKYSGTIPSSAFIGEINSSWEKHSRNND

SEQ ID NO: 831587 - protein, 278 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEHKLVGMTTEVDSVSEVKKDSSQLGTDATEKPKEVAGCGGYRAR

SEQ ID NO: 831588 - protein, 188 aa, Homo sapiens
RGDPECPRVPACFPSPHDAAGVLKQKQPGQGDPSSEQYEPFHPRPGFRASQAPLGGMFLKRVWSFESVRTGYAGCWAPCWALETEGQGRPGVSAFREMALGCLLRGSSDVQSLGTNSREHGRSETGNSQVRLSSPGVSGPPAGPQGRTHFQCAEWTQGRLVTEAPAGNSGSAGAKTGPFTFSAAHGLG

SEQ ID NO: 831589 - protein, 259 aa, Homo sapiens
MERKSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 831590 - protein, 235 aa, Homo sapiens
MDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 831591 - protein, 268 aa, Homo sapiens
WSTYRASSEEAPETPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 831592 - protein, 291 aa, Homo sapiens
MERKRWECPALPQGWEREEVPRRSGLSAGHRDVFYYSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 831593 - protein, 259 aa, Homo sapiens; identical to SEQ ID NO: 831589

SEQ ID NO: 831594 - protein, 248 aa, Homo sapiens
MDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPCLAPYDLWARGQLLPMPAVPAP

SEQ ID NO: 831595 - protein, 259 aa, Homo sapiens; identical to SEQ ID NO: 831589

SEQ ID NO: 831596 - protein, 153 aa, Homo sapiens
PAGRNSRGKWRRRQRQRSLQTRSSAPREPGSAAKPSLGDTQEEGRAPGSLLGPSPLPGASGHTAGAAPTRKTLHARPLQSPASGSAGCSWALPGSLRPLGSRPAPPHARCPSSLRLESSQQVPGSSAPRLADSWEGFSVWRRSFETHITHCAA

SEQ ID NO: 831597 - protein, 110 aa, Homo sapiens
MYEAGLNRQRLVLPGASGHTAGAAPTRKTLHARPLQSPASGSAGCSWALPGSLRPLGSRPAPPHARCPSSLRLESSQQVPGSSAPRLADSWEGFSVWRRSFETHITHCAA

SEQ ID NO: 831598 - protein, 259 aa, Homo sapiens; identical to SEQ ID NO: 831589

SEQ ID NO: 831599 - protein, 259 aa, Homo sapiens; identical to SEQ ID NO: 831589

SEQ ID NO: 831600 - protein, 102 aa, Homo sapiens
PKLGFLPRRWQLPFLGHFRGLSGPQLPRGDLSSLRLFVHCLAGVGPGCTDETLLSAIASALHTSTMPITGQLSAAVEKNPGVWLNTTQPLCKAFMVTDEDIR

SEQ ID NO: 831601 - protein, 90 aa, Homo sapiens
WGLTAGAEEAPLHRLPSKDPHGGSGLAASCCSLSESKHKSSGRAQGPGQPREAPGGDHVFLRLVPTGWDPLQWGGLPSVCLVEGAVGVGT

SEQ ID NO: 831602 - protein, 291 aa, Homo sapiens; identical to SEQ ID NO: 831592

SEQ ID NO: 831603 - protein, 259 aa, Homo sapiens; identical to SEQ ID NO: 831589

SEQ ID NO: 831604 - protein, 259 aa, Homo sapiens; identical to SEQ ID NO: 831589

SEQ ID NO: 831605 - protein, 385 aa, Homo sapiens
VLWVWLAPRSRGQLWGAGVWDEGLGSRQGWGLGLGPGPAWVWGQGRVGVWGWGRDLKLGLGLGLGLRPRPGFGVWGPPGAPTVPPPRSPEREEVPQQAAAGALPGRLHGPEHLRLPHGQDADEQDEQEPPARALRLLQPGQGQARPEHGAARAPDGVHLQAAGDQDYQPPQQQGQERPAEGGGPAAPESRSVTQAGVQWQDLNSLQPLPPGFNWVQVILPPQPHKKLGFQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 831606 - protein, 192 aa, Homo sapiens
RRPNKYRLGRGLGGLIGRGPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 831607 - protein, 137 aa, Homo sapiens
ASQQASARYRPGWFNRPRQDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 831608 - protein, 202 aa, Homo sapiens
LRLVRARVYFGRGSWPVTGRRRWTRPALRTTTRKTRRRRRRSPTRTRRWSTSRAEALPRARAACWSRLQTRSSAPREPGSAAKPSLGDTQEEGRAPGSLLGPSPLPGASGHTAGAAPTRKTLHARPLQSPASGSAGCSWALPGSLRPLGSRPAPPHARCPSSLRLESSQQVPGSSAPRLADSWEGFSVWRRSFETHITHCAA

SEQ ID NO: 831609 - protein, 209 aa, Homo sapiens
MDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRSSPCPLSQLLETGEQPAGARQLGATAC

SEQ ID NO: 831610 - protein, 259 aa, Homo sapiens; identical to SEQ ID NO: 831589

SEQ ID NO: 831611 - protein, 235 aa, Homo sapiens; identical to SEQ ID NO: 831590

SEQ ID NO: 831612 - protein, 441 aa, Homo sapiens
MLTVLHETFSQHTFLMNGLIQGVKGLLSFLSAPLIGALSDVWGRKPFLLGTVFFTCFPIPLMRISPWWYFAMISVSGVFSVTFSVIFAYVADVTQEHERSTAYGWVSATFAASLVSSPAIGAYLSASYGDSLVVLVATVVALLDICFILVAVPESLPEKMRPVSWGAQISWKQADPFASLKKVGKDSTVLLICITVFLSYLPEAGQYSSFFLYLRQVIGFGSVKIAAFIAMVGILSIVAQTAFLSILMRSLGNKNTVLLGLGFQMLQLAWYGFGSQAWMMWAAGTVAAMSSITFPAISALVSRNAESDQQGVAQGIITGIRGLCNGLGPALYGFIFYMFHVELTELGPKLNSNNVPLQGAVIPGPPFLFGACIVLMSFLVALFIPEYSKASGVQKHSNSSSGSLTNTPERGSDEDIEPLLQDSSIWELSSFEEPGNQCTEL

SEQ ID NO: 831613 - protein, 504 aa, Homo sapiens
GAAAELEEKAASEPDGGSHAGEARGRAGRGDAPGLQGFGRPSVYHAAIVIFLEFFAWGLLTTPMLTVLHETFSQHTFLMNGLIQGVKGLLSFLSAPLIGALSDVWGRKPFLLGTVFFTCFPIPLMRISPWWYFAMISVSGVFSVTFSVIFAYVADVTQEHERSTAYGWVSATFAASLVSSPAIGAYLSASYGDSLVVLVATVVALLDICFILVAVPESLPEKMRPVSWGAQISWKQADPFASLKKVGKDSTVLLICITVFLSYLPEAGQYSSFFLYLRQVIGFGSVKIAAFIAMVGILSIVAQTAFLSILMRSLGNKNTVLLGLGFQMLQLAWYGFGSQAWMMWAAGTVAAMSSITFPAISALVSRNAESDQQGVAQGIITGIRGLCNGLGPALYGFIFYMFHVELTELGPKLNSNNVPLQGAVIPGPPFLFGACIVLMSFLVALFIPEYSKASGVQKHSNSSSGSLTNTPERGSDEDIEPLLQDSSIWELSSFEEPGNQCTEL

SEQ ID NO: 831614 - protein, 213 aa, Homo sapiens [sequence omitted]

SEQ ID NO: 831615 - protein, 441 aa, Homo sapiens; identical to SEQ ID NO: 831612

SEQ ID NO: 831616 - protein, 441 aa, Homo sapiens; identical to SEQ ID NO: 831612

SEQ ID NO: 831617 - protein, 166 aa, Homo sapiens
MLTVLHETFSQHTFLMNGLIQGVKGLLSFLSAPLIGALSDVWGRKPFLLGTVFFTCFPIPLMRISPWWYFAMISVSGVFSVTFSVIFACRHACFTFGFGYDAQFLIQPLTRSAVLTEQMTALRRQANSECCTFFYQHHVVLAVDQVLTYCRDLDVNLSFITQLLYH

SEQ ID NO: 831618 - protein, 282 aa, Homo sapiens
MRPVSWGAQISWKQADPFASLKKVGKDSTVLLICITVFLSYLPEAGQYSSFFLYLRQVIGFGSVKIAAFIAMVGILSIVAQTAFLSILMRSLGNKNTVLLGLGFQMLQLAWYGFGSQAWMMWAAGTVAAMSSITFPAISALVSRNAESDQQGVAQGIITGIRGLCNGLGPALYGFIFYMFHVELTELGPKLNSNNVPLQGAVIPGPPFLFGACIVLMSFLVALFIPEYSKASGVQKHSNSSSGSLTNTPERGSDEDIEPLLQDSSIWELSSFEEPGNQCTEL

SEQ ID NO: 831619 - protein, 289 aa, Homo sapiens [sequence omitted]

SEQ ID NO: 831620 - protein, 311 aa, Homo sapiens
MLTVLHETFSQHTFLMNGLIQGVKGLLSFLSAPLIGALSDVWGRKPFLLGTVFFTCFPIPLMRISPWWYFAMISVSGVFSVTFSVIFAYVADVTQEHERSTAYGWVSATFAASLVSSPAIGAYLSASYGDSLVVLVATVVALLDICFILVAVPESLPEKMRPVSWGAQISWKQADPFASLKKVGKDSTVLLICITVFLSYLPEAGQYSSFFLYLRQVIGFGSVKIAAFIAMVGILSIVAQTAFLSILMRSLGNKNTVLLGLGFQMLQLAWYGFGSQAWSCPGDHNWNKRTMQWPGASTVWLHILHVPCGTD

SEQ ID NO: 831621 - protein, 552 aa, Homo sapiens
MGQNNVTFFFFEMESHFVAQAGIQWHNLGSLQPLHSRFKLVSCLSLLSSWDYRHTPPRPANFLYFYRDGVSPCWSGWSRTADLMIRLPWPPKVLEITGVSHCTQPQNNVTFKKLDISSLKSCRHFGDTVTVRGLEIIARLLWLLIRITMGAFKTYLCPGHTAREPDLTGLQWSSSISLLSFPCSPYPLSFAYIIDFNVQAKLRATGFANEQCCIGSIKSQSFCFIFYYLIPYLSTCGLGMERVYKTTGRHIIENVYKTFHNLSCACLERFLTSVLDINYWLYRFSFQHVLICHWFYEFSRLIIVIEHNISYYFIISILLKCFHFISMVIGFGSVKIAAFIAMVGILSIVAQTAFLSILMRSLGNKNTVLLGLGFQMLQLAWYGFGSQAWMMWAAGTVAAMSSITFPAISALVSRNAESDQQGVAQGIITGIRGLCNGLGPALYGFIFYMFHVELTELGPKLNSNNVPLQGAVIPGPPFLFGACIVLMSFLVALFIPEYSKASGVQKHSNSSSGSLTNTPERGSDEDIEPLLQDSSIWELSSFEEPGNQCTEL

SEQ ID NO: 831622 - protein, 441 aa, Homo sapiens; identical to SEQ ID NO: 831612

SEQ ID NO: 831623 - protein, 441 aa, Homo sapiens; identical to SEQ ID NO: 831612

SEQ ID NO: 831624 - protein, 968 aa, Homo sapiens
MVLGCELSGSTRVVVGVEALLTGASSPLPGVGPANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 831625 - protein, 158 aa, Homo sapiens
ESSWYHHLKTVAERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQADHKDQ

SEQ ID NO: 831626 - protein, 956 aa, Homo sapiens
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 831627 - protein, 967 aa, Homo sapiens
PEHQGGALMEVEMGGGEERADCLSLRDRWAGSLLFWLSVGIPACSFLAYGCTVSRLYLGVQYKAVSRCAHIEAVCWCTVLRLYLGVRYRTCPSMCRIKAVSDVPYRGCTSVCCIKAVSQCIMSRLAAVSSSLLLSGICRATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 831628 - protein, 468 aa, Homo sapiens [sequence omitted]

SEQ ID NO: 831629 - protein, 364 aa, Homo sapiens
MHGGQGCAPMWGVVTQLPVRALGLEVRVWGLCLHLLSLGLRAFLLFFLVLLRELCVCVQEAGRAVLMAARSVALTAHVCSVYVFLQGVAWSAQLVGSWVMLHIWLYRALLETPRRVPLLPQCEQAARWLVWASMQAGKGLAQVWGVATFVQLCAHTVFLSMYLCMHICFAAISSKVRVRVNAPFCVSVPLKVHAPLSLGIKVGLQGQKHGRATGEAGMPQGEMLGKQEPQTSRSPKPTRRREVSRSELSPVIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 831630 - protein, 956 aa, Homo sapiens; identical to SEQ ID NO: 831626

SEQ ID NO: 831631 - protein, 267 aa, Homo sapiens
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPV

SEQ ID NO: 831632 - protein, 364 aa, Homo sapiens; identical to SEQ ID NO: 831629

SEQ ID NO: 831633 - protein, 254 aa, Homo sapiens
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGESSALC

SEQ ID NO: 831634 - protein, 963 aa, Homo sapiens
MTLMQLGALWGGEERADCLSLRDRWAGSLLFWLSVGIPACSFLAYGCTVSRLYLGVQYKAVSRCAHIEAVCWCTVLRLYLGVRYRTCPSMCRIKAVSDVPYRGCTSVCCIKAVSQCIMSRLAAVSSSLLLSGICRATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 831635 - protein, 956 aa, Homo sapiens; identical to SEQ ID NO: 831626

SEQ ID NO: 831636 - protein, 551 aa, Homo sapiens
MHGGQGCAPMWGVVTQLPVRALGLEVRVWGLCLHLLSLGLRAFLLFFLVLLRELCVCVQEAGRAVLMAARSVALTAHVCSVYVFLQGVAWSAQLVGSWVMLHIWLYRALLETPRRVPLLPQCEQAARWLVWASMQAGKGLAQVWGVATFVQLCAHTVFLSMYLCMHICFAAISSKVRVRVNAPFCVSVPLKVHAPLSLGIKVGLQGQKHGRATGEAGMPQGEMLGKQEPQTSRSPKPTRRREVSRSELSPGGEGKGLLCAPWTCPQPQVLVPSSCSQPRPGACISSCSAKPVWGPLLSLTGHWHLFPRLSGLWGRHRWNDRGRFQSLPSVLLRIGLFMTVLGRESFSSSALASLYTCLPLCLFLCLAAAPFLPFRLLPFLVGCFSSGFSRCSSLLGHRVFCPGSPSARAASFPTQPPVQVPPGVPESRSAHPRALSAVIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 831637 - protein, 477 aa, Homo sapiens
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPFSLLSMGSFSPSAGLPQLDHRPCFSYDRPTSFPFQSGDPISPSFPTSFLSCPVSLPALAVLRSCSPGPSSVTWCGQAAGTGGDVGAPGVHI

SEQ ID NO: 831638 - protein, 537 aa, Homo sapiens
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTGKLLSEDSSGSGFGKGGRLVRSKGSLTQQLRPPPASLCSCAG

SEQ ID NO: 831639 - protein, 103 aa, Homo sapiens [sequence omitted]

SEQ ID NO: 831640 - protein, 330 aa, Homo sapiens [sequence omitted]

SEQ ID NO: 831641 - protein, 723 aa, Homo sapiens
GMKRIGASTKSKDRKTEVDTSHRLSIFLELIDVHRLNGEQHEATKVLQDAIHEFSGTSEEVRVTIANADLALAQGDIERALSILQNVTAEQPYFIEAREKMADIYLKHRKDKMLYITCFREIAERMANPRSFLLLGDAYMNILEPEEAIVAYEQALNQNPKDGTLASKMGKALIKTHNYSMAITYYEAALKTGQKNYLCYDLAELLLKLKWYDKAEKVLQHALAHEPVNELSALMEDGRCQVLLAKVYSKMEKLGDAITALQQARELQARVLKRVQMEQPDAVPAQKHLAAEICAEIAKHSVAQRDYEKAIKFYREALVHCETDNKIMLELARLYLAQDDPDSCLRQCALLLQSDQDNEAATMMMADLMFRKQDYEQAVFHLQQLLERKPDNYMTLSRLIDLLRRCGKLEDVPRFFSMAEKRNSRAKLEPGFQYCKGLYLWYTGEPNDALRHFNKARKDRDWGQNALYNMIEICLNPDNETVGGEVFENLDGDLGNSTEKQESVQLAVRTAEKLLKELKPQTVQGHVQLRIMENYCLMATKQKSNVEQALNTFTEIAASEKEHIPALLGMATAYMILKQTPRARNQLKRIAKMNWNAIDAEEFEKSWLLLADIYIQSAKYDMAEDLLKRCLRHNRSCCKAYEYMGYIMEKEQAYTDAALNYEMAWKYSNRTNPAVGYKLAFNYLKAKRYVDSIDICHQVLEAHPTYPKIRKDILDKARASLRP

SEQ ID NO: 831642 - protein, 723 aa, Homo sapiens; identical to SEQ ID NO: 831641

SEQ ID NO: 831643 - protein, 81 aa, Homo sapiens
TPQVMEPSDIHATVSRTFGGPSRLITRGKEFLDTPGPHGGPPLFFKITNYPAIVAHARYPRYSGGLEREIAWTREAEVSLS

SEQ ID NO: 831644 - protein, 723 aa, Homo sapiens; identical to SEQ ID NO: 831641

SEQ ID NO: 831645 - protein, 723 aa, Homo sapiens; identical to SEQ ID NO: 831641

SEQ ID NO: 831646 - protein, 637 aa, Homo sapiens
MKRIGASTKSKDRKTEVDTSHRLSIFLELIDVHRLNGEQHEATKVLQDAIHEFSGTSEEVRVTIANADLALAQGDIERALSILQNVTAEQPYFIEAREKMADIYLKHRKDKMLYITCFREIAERMANPRSFLLLGDAYMNILEPEEAIVAYEQALNQNPKDGTLASKMGKALIKTHNYSMAITYYEAALKTGQKNYLCYDLAELLLKLKWYDKAEKVLQHALAHEPVNELSALMEDGRCQVLLAKVYSKMEKLGDAITALQQARELQARVLKRVQMEQPDAVPAQKHLAAEICAEIAKHSVAQRDYEKAIKFYREALVHCETDNKIMLELARLYLAQDDPDSCLRQCALLLQSDQDNEAATMMMADLMFRKQDYEQAVFHLQQLLERKPDNYMTLSRLIDLLRRCGKLEDVPRFFSMAEKRNSRAKLEPGFQYCKGLYLWYTGEPNDALRHFNKARKDRDWGQNALYNMIEICLNPDNETVGGEVFENLDGDLGNSTEKQESVQLAVRTAEKLLKELKPQTVQGHVQLRIMENYCLMATKQKSNVEQALNTFTEIAASEKEHIPALLGMATAYMILKQTPRARNQLKRIAKMNWNAIDAEEFEKSWLLLADIYIQSAKYDMAEDLLKRCLRHNRVGD

SEQ ID NO: 831647 - protein, 491 aa, Homo sapiens
MVFGEFFHRPGQDEELVNLNVGGFKQSVDQSTLLRFPHTRLGKLLTCHSEEAILELCDDYSVADKEYYFDRNPSLFRYVLNFYYTGKLHVMEELCVFSFCQEIEYWGINELFIDSCCSNRYQERKEENHEKDWDQKSHDVSTDSSFEESSLFEKELEKFDTLRFGQLRKKIWIRMENPAYCLSAKLIAISSLSVVLASIVAMCVHSMSEFQNEDGEVDDPVLEGVEIACIAWFTGELAVRLAAAPCQKKFWKNPLNIIDFVSIIPFYATLAVDTKEEESEDIENMGKVVQILRLMRIFRILKLARHSVGLRSLGATLRHSYHEVGLLLLFLSVGISIFSVLIYSVEKDDHTSSLTSIPICWWWATISMTTVGYGDTHPVTLAGKLIASTCIICGILVVALPITIIFNKFSKYYQKQKDIDVDQCSEDAPEKCHELPYFNIRDIYAQRMHAFITSLSSVGIVVSDPDSTDASSIEDNEDICNTTSLENCTAK

SEQ ID NO: 831648 - protein, 279 aa, Homo sapiens
MVFGEFFHRPGQDEELVNLNVGGFKQSVDQSTLLRFPHTRLGKLLTCHSEEAILELCDDYSVADKEYYFDRNPSLFRYVLNFYYTGKLHVMEELCVFSFCQEIEYWGINELFIDSCCSNRYQERKEENHEKDWDQKSHDVSTDSSFEESSLFEKELEKFDTLRFGQLRKKIWIRMENPAYCLSAKLIAISSLSVVLASIVAMCVHSMSEFQNEDGEVDDPVLEGVEIACIAWFTGELAVRLAAAPCQKKFWKNPLNIIDFVSIIPFYASFCVCHLLTLS

SEQ ID NO: 831649 - protein, 491 aa, Homo sapiens; identical to SEQ ID NO: 831647

SEQ ID NO: 831650 - protein, 448 aa, Homo sapiens
MVFGEFFHRPGQDEELVNLNVGGFKQSVDQSTLLRFPHTRLGKLLTCHSEEAILELCDDYSVADKEYYFDRNPSLFRYVLNFYYTGKLHVMEELCVFSFCQEIEYWGINELFIDSCCSNRYQERKEENHEKDWDQKSHDVSTDSSFEESSLFEKELEKFDTLRFGQLRKKIWIRMENPAYCLSAKLIAISSLSVVLASIVAMCVHSMSEFQNEDGEVDDPVLEGVEIACIAWFTGELAVRLAAAPCQKKFWKNPLNIIDFVSIIPFYATLAVDTKEEESEDIENMGKVVQILRLMRIFRILKLARHSVGLRSLGATLRHSYHEVGLLLLFLSVGISIFSVLIYSVEKDDHTSSLTSIPICWWWATISMTTVGYGDTHPVTLAGKLIASTCIICGILVVALPITIIFNKFSKYYQKQKDIDVDQCSEDAPEKCHELPYFNIRDIFWNIR

SEQ ID NO: 831651 - protein, 758 aa, Homo sapiens [sequence omitted]

SEQ ID NO: 831652 - protein, 758 aa, Homo sapiens [sequence omitted]

SEQ ID NO: 831653 - protein, 758 aa, Homo sapiens [sequence omitted]

SEQ ID NO: 831654 - protein, 362 aa, Homo sapiens
MAPAMQPAEIQFAQRLASSEKGIRDRAVKKLRQYISVKTQRETGGFSQEELLKIWKGLFYCMWVQDEPLLQEELANTIAQLVHAVNNSAAQHLFIQTFWQTMNREWKGIDRLRLDKYYMLIRLVLRQSFEVLKRNGWEESRIKVFLDVLMKEVLCPESQSPNGVRFHFIDIYLDELSKVGGKELLADQNLKFIDPFCKIAAKTKDHTLVQTIARGVFEAIVDQSPFVPEETMEEQKTKVGDGDLSAEEIPENEVSLRRAVSKKKTALGKNHSRKDGLSDERGRDDCGTFEDTGPLLQFDYKAVADRLLEMTSRKNTPHFNRKRLSKLIKKFQDLSEGSSISQLSFAEDISADEDDQILSQGS

SEQ ID NO: 831655 - protein, 152 aa, Homo sapiens
MAPAMQPAEIQFAQRLASSEKGIRDRAVKKLRQYISVKTQRETGGFSQEELLKIWKGLFYCMWVQDEPLLQEELANTIAQLVHAVNNSAAQHLFIQTFWQTMNREWKGIDRLRLDKYYMLIRLVLRQSFEVLKRNGWEESRKMIMGTAIVVM

SEQ ID NO: 831656 - protein, 738 aa, Homo sapiens
MAPAMQPAEIQFAQRLASSEKGIRDRAVKKLRQYISVKTQRETGGFSQEELEELANTIAQLVHAVNNSAAQHLFIQTFWQTMNREWKGIDRLRLDKYYMLIRLVLRQSFEVLKRNGWEESRIKVFLDVLMKEVLCPESQSPNGVRFHFIDIYLDELSKVGGKELLADQNLKFIDPFCKIAAKTKDHTLVQTIARGVFEAIVDQSPFVPEETMEEQKTKVGDGDLSAEEIPENEVSLRRAVSKKKTALGKNHSRKDGLSDERGRDDCGTFEDTGPLLQFDYKAVADRLLEMTSRKNTPHFNRKRLSKLIKKFQDLSEGSSISQLSFAEDISADEDDQILSQGKHKKKGNKLLEKTNLEKEKGSRVFCVEEEDSESSLQKRRRKKKKKHHLQPENPGPGGAAPSLEQNRGREPEASGPKALKARVAEPGAEATSSTGEESGSEHPPAVPMHNKRKRPRKKSPRAHREMLESAVLPPEDMSQSGPSGSHPQGPRGSPTGGAQLLKRKRKLGVVPVNGSGLSTPAWPPLQQEGPPTGPAEGANSHTTLPQRRRLQKKKAGPGSLELCGLPSQKTASLKKRKKMRVMSNLVEHNGVLESEAGQPQALGSSGTCSSLKKQKLRAESDFVKFDTPFLPKPLFFRRAKSSTATHPPGPAVQLNKTPSSSKKVTFGLNRNMTAEFKKTDKSILVSPTGPSRVAFDPEQKPLHGVLKTPTSSPASSPLVAKKPLTTTPRRRPRAMDFF

SEQ ID NO: 831657 - protein, 141 aa, Homo sapiens
MPPIQEPRFFSKTRPVPFSTAASQQRAPGSPRSQLWLWTTWLRPLGLQSLHWVYLGLIHSWSQGWGFTCEHQTDLLASRAVDSLMKALVRRKHSVLRLLCNRFVIMSHEKSNELVLLIVTVMRSLTYNIAVVAAWFNGCIR

SEQ ID NO: 831658 - protein, 76 aa, Homo sapiens
RRFHRPSWHGAMIAVVLCVKPELCRMEGLSASAVRKTAGRRVGWICLGLCLPLLCVWAAQEALSSDPSSASHPSLT

SEQ ID NO: 831659 - protein, 400 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 831660 - protein, 370 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKGCLHDKNSDQATWLTRL

SEQ ID NO: 831661 - protein, 491 aa, Homo sapiens
MSQTGEKKKKSGRFPPAGPPPPRGPQSARPPGGGREGAGPVGASGARWDPRSPATRRAWSRAGSGKPAPARSELRSPSGGGGEGARSRRRGRPRAPPPVPRRPRAPCCPTPRARARRCRSPPRPRRRPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 831662 - protein, 400 aa, Homo sapiens; identical to SEQ ID NO: 831659

SEQ ID NO: 831663 - protein, 263 aa, Homo sapiens
MEGLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 831664 - protein, 359 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKVRGTTG

SEQ ID NO: 831665 - protein, 517 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEGKNPGFQDKGKSPCVCVCVYVCTRRHMYGPPSHVRGVTVGYTYAHACGVRPASFCLCGGLEAGPRLWGCAGPLKWYSRNGPWGQLLRQPASMHPLFEPGFPMKTGERSRPGRVTPELSLPPVPPHSEDAHSESAENRAHPENDHHRVYEPPLDHGFHSDPFSLFSAINKGPSNPTAHQPGPEGGQGAVGGCQGEGHHWVRGAPGGVGGLRGVPRCEAWCW

SEQ ID NO: 831666 - protein, 137 aa, Homo sapiens
MHPLFEPGFPMKTGERSRPGRVTPELHCPLSHPTVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 831667 - protein, 131 aa, Homo sapiens
MSQTGEKKKKSGRFPPAGPPPPRGPQSARPPGGGREGAGPVGASGARWDPRSPATRRAWSRAGSGKPAPARSELRSPSGGGGEGARSRRRGRPRAPPPVPRRPRAPCCPTEPPRPPAHGRTSNNSLQEYIF

SEQ ID NO: 831668 - protein, 378 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKRGVTGHWHCDQEDWTPSPQGPPPPT

SEQ ID NO: 831669 - protein, 387 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKEEMTSALATMRVDYEQIKIKKIEDAPSTDEEQLG

SEQ ID NO: 831670 - protein, 70 aa, Homo sapiens
KLGRLGSLGSHGTIPQDRVLARTLPQAFTRTPFLSSQQSTKVPQTPLHTSRVLKEDKERWEDVKVRGTTG

SEQ ID NO: 831671 - protein, 400 aa, Homo sapiens; identical to SEQ ID NO: 831659

SEQ ID NO: 831672 - protein, 400 aa, Homo sapiens; identical to SEQ ID NO: 831659

SEQ ID NO: 831673 - protein, 370 aa, Homo sapiens; identical to SEQ ID NO: 831660

SEQ ID NO: 831674 - protein, 234 aa, Homo sapiens
MKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 831675 - protein, 525 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEGKNPGFQDKGKSPCVCVCVYVCTRRHMYGPPSHVRGVTVGYTYAHACGVRPASFCLCGGLEAGPRLWGCAGPLKWYSRNGPWGQLLRQPASMHPLFEPGFPMKTGERSRPGRVTPELHCPLSHPTVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 831676 - protein, 125 aa, Homo sapiens
RRLVRPGYDIVDQGVADAWAEEVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 831677 - protein, 400 aa, Homo sapiens; identical to SEQ ID NO: 831659

SEQ ID NO: 831678 - protein, 381 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKRGVTGHWHCDQEDWTPSPPPSTDEEQLG

SEQ ID NO: 831679 - protein, 158 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRPPLPLPLEGEVAGILHLSSPSGAGGGGAPRVVFVYGGRRWVPAAPPLSQMVCPALDCCKLLFCMSEIVFTKQI

SEQ ID NO: 831680 - protein, 651 aa, Homo sapiens
MKPGKPKADAKKVPKKPEEITPENHVEGTARLVTDTAEILSRLGGVELLQDTLGHVMPSVQLPPNINLVPKVPVPLNTTKYNSALDTNATMINSFNKFPYPTQAELSWLTAASKHPEEHIRIWFATQRLKHGISWSPEEVEEARKKMFNGTIQSVPPTITVLPAQLAPTKVTQPILQTALPCQILGQTSLVLTQVTSGSTTVSCSPITLAVAGVTNHGQKRPLVTPQAAPEPKRPHIAQVPEPPPKVANPPLTPASDRKKTKEQIAHLKASFLQSQFPDDAEVYRLIEVTGLARSEIKKWFSDHRYRCQRGIVHITSESLAKDQLAIAASRHGRTYHAYPDFAPQKFKEKTQGQVKILEDSFLKSSFPTQAELDRLRVETKLSRREIDSWFSERRKLRDSMEQAVLDSMGSGKKGQDVGAPNGALSRLDQLSGAQLTSSLPSPSPAIAKSQEQVHLLRSTFARTQWPTPQEYDQLAAKTGLVRTEIVRWFKENRCLLKTGTVKWMEQYQHQPMADDHGYDAVARKATKPMAESPKNGGDVVPQYYKDPKKLCEEDLEKLVTRVKVGSEPAKDCLPAKPSEATSDRSEGSSRDGQGSDENEESSVVDYVEVTVGEEDAISDRSDSWSQAAAEGVSELAESDSDCVPAEAGQA

SEQ ID NO: 831681 - protein, 768 aa, Homo sapiens
STHTNHHHTLRKPNRTTQCRTLFPILHPSRIPTTAGSTSLYPKHHRLTKLLNYPSLSDHNSKFHPGEANFKLKLIKRNNQTVLEQSIETTNHVVSITTSGPGTGDSDSGISVSKTPIMKPGKPKADAKKVPKKPEEITPENHVEGTARLVTDTAEILSRLGGVELLQDTLGHVMPSVQLPPNINLVPKVPVPLNTTKYNSALDTNATMINSFNKFPYPTQAELSWLTAASKHPEEHIRIWFATQRLKHGISWSPEEVEEARKKMFNGTIQSVPPTITVLPAQLAPTKVTQPILQTALPCQILGQTSLVLTQVTSGSTTVSCSPITLAVAGVTNHGQKRPLVTPQAAPEPKRPHIAQVPEPPPKVANPPLTPASDRKKTKEQIAHLKASFLQSQFPDDAEVYRLIEVTGLARSEIKKWFSDHRYRCQRGIVHITSESLAKDQLAIAASRHGRTYHAYPDFAPQKFKEKTQGQVKILEDSFLKSSFPTQAELDRLRVETKLSRREIDSWFSERRKLRDSMEQAVLDSMGSGKKGQDVGAPNGALSRLDQLSGAQLTSSLPSPSPAIAKSQEQVHLLRSTFARTQWPTPQEYDQLAAKTGLVRTEIVRWFKENRCLLKTGTVKWMEQYQHQPMADDHGYDAVARKATKPMAESPKNGGDVVPQYYKDPKKLCEEDLEKLVTRVKVGSEPAKDCLPAKPSEATSDRSEGSSRDGQGSDENEESSVVDYVEVTVGEEDAISDRSDSWSQAAAEGVSELAESDSDCVPAEAGQA

SEQ ID NO: 831682 - protein, 837 aa, Homo sapiens
MASKRKSTTPCMVRTSQVVEQDVPEEVDRAKEKGIGTPQPDVAKDSWAAELENSSKENEVIEVKSMGESQSKKLQGGYECKYCPYSTQNLNEFTEHVDMQHPNVILNPLYVCAECNFTTKKYDSLSDHNSKFHPGEANFKLKLIKRNNQTVLEQSIETTNHVVSITTSGPGTGDSDSGISVSKTPIMKPGKPKADAKKVPKKPEEITPENHVEGTARLVTDTAEILSRLGGVELLQDTLGHVMPSVQLPPNINLVPKVPVPLNTTKYNSALDTNATMINSFNKFPYPTQAELSWLTAASKHPEEHIRIWFATQRLKHGISWSPEEVEEARKKMFNGTIQSVPPTITVLPAQLAPTKVTQPILQTALPCQILGQTSLVLTQVTSGSTTVSCSPITLAVAGVTNHGQKRPLVTPQAAPEPKRPHIAQVPEPPPKVANPPLTPASDRKKTKEQIAHLKASFLQSQFPDDAEVYRLIEVTGLARSEIKKWFSDHRYRCQRGIVHITSESLAKDQLAIAASRHGRTYHAYPDFAPQKFKEKTQGQVKILEDSFLKSSFPTQAELDRLRVETKLSRREIDSWFSERRKLRDSMEQAVLDSMGSGKKGQDVGAPNGALSRLDQLSGAQLTSSLPSPSPAIAKSQEQVHLLRSTFARTQWPTPQEYDQLAAKTGLVRTEIVRWFKENRCLLKTGTVKWMEQYQHQPMADDHGYDAVARKATKPMAESPKNGGDVVPQYYKDPKKLCEEDLEKLVTRVKVGSEPAKDCLPAKPSEATSDRSEGSSRDGQGSDENEESSVVDYVEVTVGEEDAISDRSDSWSQAAAEGVSELAESDSDCVPAEAGQA

SEQ ID NO: 831683 - protein, 837 aa, Homo sapiens; identical to SEQ ID NO: 831682

SEQ ID NO: 831684 - protein, 652 aa, Homo sapiens
RAQSCPCILYLCKLCPKPEEITPENHVEGTARLVTDTAEILSRLGGVELLQDTLGHVMPSVQLPPNINLVPKVPVPLNTTKYNSALDTNATMINSFNKFPYPTQAELSWLTAASKHPEEHIRIWFATQRLKHGISWSPEEVEEARKKMFNGTIQSVPPTITVLPAQLAPTKVTQPILQTALPCQILGQTSLVLTQVTSGSTTVSCSPITLAVAGVTNHGQKRPLVTPQAAPEPKRPHIAQVPEPPPKVANPPLTPASDRKKTKEQIAHLKASFLQSQFPDDAEVYRLIEVTGLARSEIKKWFSDHRYRCQRGIVHITSESLAKDQLAIAASRHGRTYHAYPDFAPQKFKEKTQGQVKILEDSFLKSSFPTQAELDRLRVETKLSRREIDSWFSERRKLRDSMEQAVLDSMGSGKKGQDVGAPNGALSRLDQLSGAQLTSSLPSPSPAIAKSQEQVHLLRSTFARTQWPTPQEYDQLAAKTGLVRTEIVRWFKENRCLLKTGTVKWMEQYQHQPMADDHGYDAVARKATKPMAESPKNGGDVVPQYYKDPKKLCEEDLEKLVTRVKVGSEPAKDCLPAKPSEATSDRSEGSSRDGQGSDENEESSVVDYVEVTVGEEDAISDRSDSWSQAAAEGVSELAESDSDCVPAEAGQA

SEQ ID NO: 831685 - protein, 189 aa, Homo sapiens
MASKRKSTTPCMVRTSQVVEQDVPEEVDRAKEKGIGTPQPDVAKDSWAAELENSSKENEVIEVKSMGESQSKKLQGGYECKYCPYSTQNLNEFTEHVDMQHPNVILNPLYVCAECNFTTKKYDSLSDHNSKFHPGEANFKLKLIKRNNQTVLEQSIETTNQMCPLYMRDGVSEPRNCVGTLPRSHDWSV

SEQ ID NO: 831686 - protein, 144 aa, Homo sapiens
MEFEVVKPPPSSAPARRGASVAKPRRPGLPGAALSDPARAPSGVASLNQSALSRPMQRKLVTLVNCQLVEEEGRVRAMRAARSLGERTVTELILQHQNPQQLSANLWAAVRARGCQFLGPGKIGYYLTFFISYWGLRMPISGAR

SEQ ID NO: 831687 - protein, 1191 aa, Homo sapiens
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGEDHVILEEQKTILPVTSCFSQPLPVSISNASCLPITTSVSAGNLILKTHVMSEDKNDFLKPVANGKMVNS

SEQ ID NO: 831688 - protein, 1152 aa, Homo sapiens
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFNKIIVEKAMRPLSLSQTANTRLACAEICDSKGVVHEEQIVHLPILRKSLKRSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGEDHVILEEQKTILPVTSCFSQPLPVSISNASCLPITTSVSAGNLILKTHVMSEDKNDFLKPVANGKMVNS

SEQ ID NO: 831689 - protein, 1064 aa, Homo sapiens
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGEVKKLNLSASCLMYLFSAAASWLYHY

SEQ ID NO: 831690 - protein, 1129 aa, Homo sapiens
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGRSKKQFCR

SEQ ID NO: 831691 - protein, 1134 aa, Homo sapiens
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPRFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGEDHVILEEQKTILPVTSCFSQPLPVSISNASCLPITTSVSAGNLILKTHVMSEDKNDFLKPVANGKMVNS

SEQ ID NO: 831692 - protein, 1191 aa, Homo sapiens; identical to SEQ ID NO: 831687

SEQ ID NO: 831693 - protein, 1191 aa, Homo sapiens; identical to SEQ ID NO: 831687

SEQ ID NO: 831694 - protein, 1062 aa, Homo sapiens
MQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGEDHVILEEQKTILPVTSCFSQPLPVSISNASCLPITTSVSAGNLILKTHVMSEDKNDFLKPVANGKMVNS

SEQ ID NO: 831695 - protein, 621 aa, Homo sapiens
SNQPGIRVLVDDGIAADLLGAVSIPEGAESLLVIDVSRAQRCNMAVRYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGEDHVILEEQKTILPVTSCFSQPLPVSISNASCLPITTSVSAGNLILKTHVMSEDKNDFLKPVANGKMVNS

SEQ ID NO: 831696 - protein, 1064 aa, Homo sapiens; identical to SEQ ID NO: 831689

SEQ ID NO: 831697 - protein, 509 aa, Homo sapiens
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQPPQAPPAPQAPPQPQAAPPQQPAAPPQQPQAHTLTTLSSEPGQSQRTHIKTEQLSPSHYSEQQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 831698 - protein, 509 aa, Homo sapiens; identical to SEQ ID NO: 831697

SEQ ID NO: 831699 - protein, 509 aa, Homo sapiens; identical to SEQ ID NO: 831697

SEQ ID NO: 831700 - protein, 509 aa, Homo sapiens; identical to SEQ ID NO: 831697

SEQ ID NO: 831701 - protein, 119 aa, Homo sapiens
VIRRGPLRSDLKTLGNRRGGAQLENLELQREEVGRPQPPALGTTRLHTAHSTLRRPPTKGEDGRDDPKNNRRKRGPTRIPFGHLCFFVFLFCFVFSSSSSSLKTFKLKATRTQISKTQT

SEQ ID NO: 831702 - protein, 509 aa, Homo sapiens; identical to SEQ ID NO: 831697

SEQ ID NO: 831703 - protein, 341 aa, Homo sapiens
MPFPFGKSHKSPADIVKNLKESMAVLEKQDISDKKAEKATEEVSKNLVAMKEILYGTNEKEPQTEAVAQLAQELYNSGLLSTLVADLQLIDFEGKKDVAQIFNNILRRQIGTRTPTVEYICTQQNILFMLLKGYESPEIALNCGIMLRECIRHEPLAKIILWSEQFYDFFRYVEMSTFDIASDAFATFKDLLTRHKLLSAEFLEQHYDRFFSEYEKLLHSENYVTKRQSLKLLGELLLDRHNFTIMTKYISKPENLKLMMNLLRDKSRNIQFEAFHVFKVFVANPNKTQPILDILLKNQAKLIEFLSKFQNDRTEDEQFNDEKTYLVKQIRDLKRPAQQEA

SEQ ID NO: 831704 - protein, 341 aa, Homo sapiens; identical to SEQ ID NO: 831703

SEQ ID NO: 831705 - protein, 226 aa, Homo sapiens
TPDKLTDSKDNPYTFCIMYESPEIALNCGIMLRECIRHEPLAKIILWSEQFYDFFRYVEMSTFDIASDAFATFKDLLTRHKLLSAEFLEQHYDRFFSEYEKLLHSENYVTKRQSLKLLGELLLDRHNFTIMTKYISKPENLKLMMNLLRDKSRNIQFEAFHVFKVFVANPNKTQPILDILLKNQAKLIEFLSKFQNDRTEDEQFNDEKTYLVKQIRDLKRPAQQEA

SEQ ID NO: 831706 - protein, 205 aa, Homo sapiens
MPFPFGKSHKSPADIVKNLKESMAVLEKQDISDKKAEKATEEVSKNLVAMKEILYGTNEKEPQTEAVAQLAQELYNSGLLSTLVADLQLIDFEGKKDVAQIFNNILRRQIGTRTPTVEYICTQQNILFMLLKGYESPEIALNCGIMLRECIRHEPLAKIILWSEQFYDFFRYVEMSTFDIASDAFATFKFASSNSAWLQLIKKLI

SEQ ID NO: 831707 - protein, 341 aa, Homo sapiens; identical to SEQ ID NO: 831703

SEQ ID NO: 831708 - protein, 182 aa, Homo sapiens
MPFPFGKSHKSPADIVKNLKESMAVLEKQDISDKKAEKATEEVSKNLVAMKEILYGTNEKEPQTEAVAQLAQELYNSGLLSTLVADLQLIDFEGKKDVAQIFNNILRRQIGTRTPTVEYICTQQNILFMLLKGYESPEIALNCGIMLRECIRHEPLAKIILWSEQSGDSYEHDDIFAFEYTS

SEQ ID NO: 831709 - protein, 134 aa, Homo sapiens
MSFFSEYEKLLHSENYVTKRQSLKLLGELLLDRHNFTIMTKYISKPENLKLMMNLLRDKSRNIQFEAFHVFKVFVANPNKTQPILDILLKNQAKLIEFLSKFQNDRTEDEQFNDEKTYLVKQIRDLKRPAQQEA

SEQ ID NO: 831710 - protein, 341 aa, Homo sapiens; identical to SEQ ID NO: 831703

SEQ ID NO: 831711 - protein, 341 aa, Homo sapiens; identical to SEQ ID NO: 831703

SEQ ID NO: 831712 - protein, 130 aa, Homo sapiens
MGMGQKEAPHCGEVRGGFGTGVRGGGRCDLGLSPLRSLWLWSWGPLWGSEVRLRLGSRVKLSPPAPPPKSGERYRKVMPSLRSLSDKRIARTHPLQRYLLETKDFPTCLYLVTEGISKTSCSFLSIVFIS

SEQ ID NO: 831713 - protein, 130 aa, Homo sapiens; identical to SEQ ID NO: 831712

SEQ ID NO: 831714 - protein, 130 aa, Homo sapiens; identical to SEQ ID NO: 831712

SEQ ID NO: 831715 - protein, 618 aa, Homo sapiens
PPQPAAAGRTLPRPSMSLPVVLPGSCCPVAGLSGGPQAGGPGAAAAAAQEPPLPPLRPRWPRGALQPPSRPRCAATAAAGVLAAPPALSSRRAVAAAAAAAPGSALLPARPLLSLGLLQLILGCCMVALSFGALSLSSSPQVKNSCPFWAGSSVILSGIIGLTTWKRPMILLVNLFVLLSVVCVLLNLAGFILGCQGAQFVSSVPRCDLVDLGEGKICFCCEEFQPAKCTDKENALKLFPVQPCSAVHLLLKKVLFALCALNALTTTVCLVAAALRYLQIFATRRSCIDESQISAEEAEDHGRIPDPDDFVPPVPPPSYFATFYSCTPRMNRRMVGPDVIPLPHIYGARIKGVEVFCPLDPPPPYEAVVSQMDQEQGSSFQMSEGSEAAVIPLDLGCTQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 831716 - protein, 399 aa, Homo sapiens
MHPLLRIVLWRQRYYYFKDFLHCILVMFVEVLSGAIVSLPQKVLFALCALNALTTTVCLVAAALRYLQIFATRRSCIDESQISAEEAEDHGRIPDPDDFVPPVPPPSYFATFYSCTPRMNRRMVGPDVIPLPHIYGARIKGVEVFCPLDPPPPYEAVGSSFQMSEGSEAAVIPLDLGCTQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 831717 - protein, 119 aa, Homo sapiens
MDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 831718 - protein, 67 aa, Homo sapiens
VCLECPDHHRLLGGRCPPLPPDIRNQEILHRKSMQGHHGHVSAEPAHGPLRVIHCLSPRAFVMKAVD

SEQ ID NO: 831719 - protein, 239 aa, Homo sapiens
MTCFGPYPIGTGLQGITLCYSCFPSFCKMKSRMCMAISICQMLSMLSFVVCAFRYRHMFKRGWPMGTCCLFLPTAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 831720 - protein, 610 aa, Homo sapiens
PPQPAAAGRTLPRPSMSLPVVLPGSCCPVAGLSGGPQAGGPGAAAAAAQEPPLPPLRPRWPRGALQPPSRPRCAATAAAGVLAAPPALSSRRAVAAAAAAAPGSALLPARPLLSLGLLQLILGCCMVALSFGALSLSSSPQVKNSCPFWAGSSVILSGIIGLTTWKRPMILLVNLFVLLSVVCVLLNLAGFILGCQGAQFVSSVPRCDLVDLGEGKICFCCEEFQPAKCTDKENALKLFPVQPCSAVHLLLKKVLFALCALNALTTTVCLVAAALRYLQIFATRRSCIDESQISAEEAEDHGRIPDPDDFVPPVPPPSYFATFYSCTPRMNRRMVGPDVIPLPHIYGARIKGVEVFCPLDPPPPYEAVGSSFQMSEGSEAAVIPLDLGCTQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 831721 - protein, 277 aa, Homo sapiens
MVGPDVIPLPHIYGARIKGVEVFCPLDPPPPYEAVGSSFQMSEGSEAAVIPLDLGCTQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 831722 - protein, 458 aa, Homo sapiens
PPQPAAAGRTLPRPSMSLPVVLPGSCCPVAGLSGGPQAGGPGAAAAAAQEPPLPPLRPRWPRGALQPPSRPRCAATAAAGVLAAPPALSSRRAVAAAAAAAPGSALLPARPLLSLGLLQLILGCCMVALSFGALSLSSSPQVKNSCPFWAGSSVILSGIIGLTTWKRPMILLVNLFVLLSVVCVLLNLAGFILGCQGAQFVSSVPRCDLVDLGEGKICFCCEEFQPAKCTDKENALKLFPVQPCSAVHLLLKKVLFALCALNALTTTVCLVAAALRYLQIFATRRSCIDESQISAEEAEDHGRIPDPDDFVPPVPPPSYFATFYSCTPRMNRRMVGPDVIPLPHIYGARIKGVEVFCPLDPPPPYEAVVSQMDQEQGSSFQMSEGSEAAVIPLDLGCTQVTQDGDIPNIPAEENASTSTPSSTLVRPIRSRRALPPLRTRSKSDPVLHPSEERENYKK

SEQ ID NO: 831723 - protein, 656 aa, Homo sapiens
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLIIAASFACYCTNMENTYGLEVVGHIPQGIPSPRAPPMNILSAVITEAFGVALVGYVASLALAQGSAKKFKYSIDDNQEFLAHGLSNIVSSFFFCIPSAAAMGRTAGLYSTGAKTQVACLISCIFVLIVIYAIGPLLYWLPMCVLASIIVVGLKGMLIQFRDLKKYWNVDKIDWGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTYYGNLDSEKPIFFESVSAAISHIHSNKNLSKLSDHSEV

SEQ ID NO: 831724 - protein, 226 aa, Homo sapiens
FCFLFLFQGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTYYGNLDSEKPIFFESVSAAISHIHSNKNLSKLSDHSEV

SEQ ID NO: 831725 - protein, 629 aa, Homo sapiens
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLIIAASFACYCTNMENTYGLEVVGHIPQGIPSPRAPPMNILSAVITEAFGVALVGYVASLALAQGSAKKFKYSIDDNQEFLAHGLSNIVSSFFFCIPSAAAMGRTAGLYSTGAKTQVACLISCIFVLIVIYAIGPLLYWLPMCVLASIIVVGLKGMLIQFRDLKKYWNVDKIDWGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTHVDPRQRLIYD

SEQ ID NO: 831726 - protein, 226 aa, Homo sapiens; identical to SEQ ID NO: 831724

SEQ ID NO: 831727 - protein, 233 aa, Homo sapiens
FCFLFLFQGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTYYGNLDSEKPIFFESVSAAISHIHSNKASYKLLFDNLDLPTMPPL

SEQ ID NO: 831728 - protein, 470 aa, Homo sapiens
SGRACVAARGPGFGLQGALVQSPPVSAGSRPRRPPRSRTGAAMSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSAR

SEQ ID NO: 831729 - protein, 470 aa, Homo sapiens; identical to SEQ ID NO: 831728

SEQ ID NO: 831730 - protein, 426 aa, Homo sapiens
SGRACVAARGPGFGLQGALVQSPPVSAGSRPRRPPRSRTGAAMSSSPWEPATLRRVFVVGVGMTKFVKPGAENSRDYPDLAEEAGKKALADAQIPYSAVDQACVGYVFGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSAR

SEQ ID NO: 831731 - protein, 470 aa, Homo sapiens; identical to SEQ ID NO: 831728

SEQ ID NO: 831732 - protein, 470 aa, Homo sapiens; identical to SEQ ID NO: 831728

SEQ ID NO: 831733 - protein, 454 aa, Homo sapiens
SGRACVAARGPGFGLQGALVQSPPVSAGSRPRRPPRSRTGAAMSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAAR

SEQ ID NO: 831734 - protein, 470 aa, Homo sapiens; identical to SEQ ID NO: 831728

SEQ ID NO: 831735 - protein, 470 aa, Homo sapiens; identical to SEQ ID NO: 831728

SEQ ID NO: 831736 - protein, 470 aa, Homo sapiens; identical to SEQ ID NO: 831728

SEQ ID NO: 831737 - protein, 470 aa, Homo sapiens; identical to SEQ ID NO: 831728

SEQ ID NO: 831738 - protein, 470 aa, Homo sapiens; identical to SEQ ID NO: 831728

SEQ ID NO: 831739 - protein, 226 aa, Homo sapiens
RGRACVAARGPGFGLQGALVQSPPVSAGSRPRRPPRSRTGAAMSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGIPSSKMNTV

SEQ ID NO: 831740 - protein, 452 aa, Homo sapiens
SGRACVAARGPGFGLQGALVQSPPVSAGSRPRRPPRSRTGAAMSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSAR

SEQ ID NO: 831741 - protein, 470 aa, Homo sapiens; identical to SEQ ID NO: 831728

SEQ ID NO: 831742 - protein, 470 aa, Homo sapiens; identical to SEQ ID NO: 831728

SEQ ID NO: 831743 - protein, 470 aa, Homo sapiens; identical to SEQ ID NO: 831728

SEQ ID NO: 831744 - protein, 470 aa, Homo sapiens; identical to SEQ ID NO: 831728

SEQ ID NO: 831745 - protein, 470 aa, Homo sapiens; identical to SEQ ID NO: 831728

SEQ ID NO: 831746 - protein, 408 aa, Homo sapiens
SGRACVAARGPGFGLQGALVQSPPVSAGSRPRRPPRSRTGAAMSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGGHSCS

SEQ ID NO: 831747 - protein, 361 aa, Homo sapiens
AGWTSSCPGPLATPHTASLGWGWDCGLASWVGESESAPRSTCQPSGHVRARGDPGSHPGLHPAARLPFLATCHHRSSSLGPLGGMGRPSSPRAAWGTFSPPQRTQVPDCHSARSKTYGNVLVLDGVIQCTERDEFSYQEMIANLPLCSHPNPRKVLIIGGGDGGVLREVVKHPSVESVVQCEIDEDVIQVSKKFLPGMAIGYSSSKLTLHVGDGFEFMKQNQDAFDVIITDSSDPMGPAESLFKESYYQLMKTALKEDGVLCCQGRVPVAAPGPHQGDAAVLPVPVPRGGLCLLHHPHLPQRPDRLHAVQQEPEHELPGAGAAADTAAGGADAAEVLQLRRAPRRLCAARVCPQGALNDVS

SEQ ID NO: 831748 - protein, 193 aa, Homo sapiens
DSRGLCRGGVVQCEIDEDVIQVSKKFLPGMAIGYSSSKLTLHVGDGFEFMKQNQDAFDVIITDSSDPMGPAESLFKESYYQLMKTALKEDGVLCCQGRVPVAAPGPHQGDAAVLPVPVPRGGLCLLHHPHLPQRPDRLHAVQQEPEHELPGAGAAADTAAGGADAAEVLQLRRAPRRLCAARVCPQGALNDVS

SEQ ID NO: 831749 - protein, 217 aa, Homo sapiens
MEPGPDGPAASGPAAIREGWFRETCSLWPGQALSLQVEQLLHHRRSRYQDILVFRSKTYGNVLVLDGVIQCTERDEFSYQEMIANLPLCSHPNPRKVLIIGGGDGGVLREVVKHPSVESVVQCEIDEDVIQVSKKFLPGMAIGYSSSKLTLHVGDGFEFMKQNQDAFDVIITDSSDPMGPAESLFKESYYQLMKTALKEDGVLCCQGARTSRSRCSR

SEQ ID NO: 831750 - protein, 69 aa, Homo sapiens
AAAYYYYCSEFKLLTMYGDMLCSKNPSTNFQEPVQPLTQQQVAQMQLKYYNSDVHRAAFVLPEFARKGP

SEQ ID NO: 831751 - protein, 303 aa, Homo sapiens
MEPGPDGPAASGPAAIREGWFRETCSLWPGQALSLQVEQLLHHRRSRYQDILVFRSKTYGNVLVLDGVIQCTERDEFSYQEMIANLPLCSHPNPRKVLIIGGGDGGVLREVVKHPSVESVVQCEIDEDVIQVSKKFLPGMAIGYSSSKLTLHVGDGFEFMKQNQDAFDVIITDSSDPMGPAESLFKESYYQLMKTALKEDGVLCCQGRVPVAAPGPHQGDAAVLPVPVPRGGLCLLHHPHLPQRPDRLHAVQQEPEHELPGAGAAADTAAGGADAAEVLQLRRAPRRLCAARVCPQGALNDVS

SEQ ID NO: 831752 - protein, 303 aa, Homo sapiens; identical to SEQ ID NO: 831751

SEQ ID NO: 831753 - protein, 209 aa, Homo sapiens
MEPGPDGPAASGPAAIREGWFRETCSLWPGQALSLQVEQLLHHRRSRYQDILVFRSKTYGNVLVLDGVIQCTERDEFSYQEMIANLPLCSHPNPRKVLIIGGGDGGVLREVVKHPSVESVVQCEIDEDVIQVSKKFLPGMAIGYSSSKLTLHVGDGFEFMKQNQDAFDVIITDSSDPMGPAESLFKESYYQLMKTALKEDGVLCCQGSR

SEQ ID NO: 831754 - protein, 325 aa, Homo sapiens
MEPGPDGPAASGPAAIREGWFRETCSLWPGQALSLQVEQLLHHRRSRYQDILVFRSKTYGNVLVLDGVIQCTERDEFSYQEMIANLPLCSHPNPRKVLIIGGGDGGVLREVVKHPSVESVVQCEIDEDVIQVSKKFLPGMAIGYSSSKLTLHVGDGFEFMKQNQDAFDVIITDSSDPMGPAESLFKESYYQLMKTALKEDGVLCCQGRVPVAAPGPHQGDAAVLPVPVPRGGLCLLHHPHLPQRPDRLHAVQQEPEHELPGAGAAADTAAGGADAAEVLQLRRAPRRLCAARVCPQGWVACGAGWWDPGTQSALLTGLMSLQGPE

SEQ ID NO: 831755 - protein, 272 aa, Homo sapiens
MEPGPDGPAASGPAAIREGWFRETCSLWPGQALSLQVEQLLHHRRSRYQDILVFRSKTYGNVLVLDGVIQCTERDEFSYQEMIANLPLCSHPNPRKVLIIGGGDGGVLREVVKHPSVESVVQCEIDEDVIQVSKKFLPGMAIGYSSSKLTLHVGDGFEFMKQNQDAFDVIITDSSDPMGPAESLFKESYYQLMKTALKEDGVLCCQGRVPVAAPGPHQGDAAVLPVPVPRGGLCLLHHPHLPQRPDRLHAVQQEPGEMGVSGGGGWGEGGHK

SEQ ID NO: 831756 - protein, 67 aa, Homo sapiens
LYALEQGRNPQGLTSLLVCREDRINMSTAGKVIKCKAAVLWELKKPFSIEEVEVAPPKAHEVRIKMV

SEQ ID NO: 831757 - protein, 375 aa, Homo sapiens [sequence omitted]

SEQ ID NO: 831758 - protein, 375 aa, Homo sapiens [sequence omitted]

SEQ ID NO: 831759 - protein, 375 aa, Homo sapiens [sequence omitted]

SEQ ID NO: 831760 - protein, 375 aa, Homo sapiens [sequence omitted]

SEQ ID NO: 831761 - protein, 359 aa, Homo sapiens
MSTAGKVIKCKAAVLWEVKKPFSIEDVEVAPPKAYEVRIKMVAVGICRTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEF

SEQ ID NO: 831762 - protein, 359 aa, Homo sapiens; identical to SEQ ID NO: 831761

SEQ ID NO: 831763 - protein, 112 aa, Homo sapiens
MSTAGKVIKCKAAVLWEVKKPFSIEDVEVAPPKAYEVRIKMVAVGICRTDDHVVSGNLVTPLPVILGHEAAGIVESVGEGVTTVKPGTGFTLREHVWFTIQDFPAWIRKPRQ

SEQ ID NO: 831764 - protein, 99 aa, Homo sapiens
MASLLCCHEACGTSVIVGVPPDSQNLSMNPMLLLTGRTWKGAILGGFKSKECVPKLVADFMAKKFSLDALITHVLPFEKINEGFDLLHSGKSIRTILMF

SEQ ID NO: 831765 - protein, 137 aa, Homo sapiens [sequence omitted]

SEQ ID NO: 831766 - protein, 266 aa, Homo sapiens
MASLLCCHEACGTSVIVGVPPDSQNLSMNPMLLLTGRTWKGAILGGFKRQERVPKLVADSTAKTPPIECINNPSPPFSPTKRRIISRFTPGYKNTTYYSPSYHTPHRLSLKMNYKIDETKKNAPSSGSRPNTTPILSTYFPPLHQPHYSSHYFSQTHLFDLNLTTQLISPQPPTILICSPFFFNRHTPVSKCFTPSPPTPVSSHCTIHAPATPIQHAMHKCIRTHTAPLSHPYNIYLLPTTPQSPSFYVFIDAFYRPPVAVPPTRD

SEQ ID NO: 831767 - protein, 375 aa, Homo sapiens [sequence omitted]

SEQ ID NO: 831768 - protein, 375 aa, Homo sapiens [sequence omitted]

SEQ ID NO: 831769 - protein, 375 aa, Homo sapiens [sequence omitted]

SEQ ID NO: 831770 - protein, 357 aa, Homo sapiens
MSTAGKVIKCKAAVLWEVKKPFSIEDVEVAPPKAYEVRIKMVAVGICRTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVASTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 831771 - protein, 375 aa, Homo sapiens [sequence omitted]

SEQ ID NO: 831772 - protein, 381 aa, Homo sapiens
MSTAGKVIKCKAAVLWEVKKPFSIEDVEVAPPKAYEVRIKMVAVGICRTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSLQPPLPYKIWSNS

SEQ ID NO: 831773 - protein, 92 aa, Homo sapiens
MASLLCCHEACGTSVIVGVPPDSQNLSMNPMLLLTGRTWKGAILGGFKSKECVPKLVADFMAKKFSLDALITHVLPFEKINEGFDLLHSGKR

SEQ ID NO: 831774 - protein, 662 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKINAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 831775 - protein, 662 aa, Homo sapiens; identical to SEQ ID NO: 831774

SEQ ID NO: 831776 - protein, 662 aa, Homo sapiens; identical to SEQ ID NO: 831774

SEQ ID NO: 831777 - protein, 662 aa, Homo sapiens; identical to SEQ ID NO: 831774

SEQ ID NO: 831778 - protein, 651 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKINAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKPPLPDGTDCLLPGPGIQGCIAEGQREGAGRRKEEEILGFWGFPIQLGNRLFHGGDLSAPDGLSPGGQQAHLQPHPFDHPVLHAPDVRPAASEGHAAAPAGQGHLQLAPEGAERHQRQAEVPEGAACTADAGSAPACPVPRLTTLCPAP

SEQ ID NO: 831779 - protein, 291 aa, Homo sapiens [sequence omitted]

SEQ ID NO: 831780 - protein, 184 aa, Homo sapiens [sequence omitted]

SEQ ID NO: 831781 - protein, 136 aa, Homo sapiens [sequence omitted]

SEQ ID NO: 831782 - protein, 86 aa, Homo sapiens
RGRGQADGLAGNAAGRMGRLWDAPPFRDHPPPRPSRTGSRLGEVLAVYAPKSTWAWSRTEPCCQRYTQSNSTPGACHSNSILNRSW

SEQ ID NO: 831783 - protein, 662 aa, Homo sapiens; identical to SEQ ID NO: 831774

SEQ ID NO: 831784 - protein, 662 aa, Homo sapiens; identical to SEQ ID NO: 831774

SEQ ID NO: 831785 - protein, 616 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKINAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 831786 - protein, 291 aa, Homo sapiens [sequence omitted]

SEQ ID NO: 831787 - protein, 662 aa, Homo sapiens; identical to SEQ ID NO: 831774

SEQ ID NO: 831788 - protein, 324 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRCACLGFIMDQSKPR

SEQ ID NO: 831789 - protein, 423 aa, Homo sapiens
GDMRWILFIGALIGSSICGREKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 831790 - protein, 423 aa, Homo sapiens; identical to SEQ ID NO: 831789

SEQ ID NO: 831791 - protein, 423 aa, Homo sapiens; identical to SEQ ID NO: 831789

SEQ ID NO: 831792 - protein, 434 aa, Homo sapiens
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 831793 - protein, 170 aa, Homo sapiens
MNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGGYPPSCYQSDGRLQ

SEQ ID NO: 831794 - protein, 253 aa, Homo sapiens
MNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 831795 - protein, 455 aa, Homo sapiens
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQSLVKDPKERGSKGSDIQPTSVVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 831796 - protein, 276 aa, Homo sapiens
MKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGGYPPSCYQSDGRLQ

SEQ ID NO: 831797 - protein, 170 aa, Homo sapiens; identical to SEQ ID NO: 831793

SEQ ID NO: 831798 - protein, 170 aa, Homo sapiens; identical to SEQ ID NO: 831793

SEQ ID NO: 831799 - protein, 253 aa, Homo sapiens; identical to SEQ ID NO: 831794

SEQ ID NO: 831800 - protein, 107 aa, Homo sapiens
MDDQSRMLQTLAGVNLAGHSVQGGMALPPPPHGHEGADGDGRKQDIGDILHQIMTITDQSLDEAQAKKHALNCHRMKPALFSVLCEIKEKTECPHLNFFLTTHGFGL

SEQ ID NO: 831801 - protein, 127 aa, Homo sapiens
MDDQSRMLQTLAGVNLAGHSVQGGMALPPPPHGHEGADGDGRKQDIGDILHQIMTITDQSLDEAQAKKHALNCHRMKPALFSVLCEIKEKTGKTLRPAVGLETPEVGVGATPSTLQLRAAAFGHRHL

SEQ ID NO: 831802 - protein, 434 aa, Homo sapiens; identical to SEQ ID NO: 831792

SEQ ID NO: 831803 - protein, 351 aa, Homo sapiens
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGGYPPSCYQSDGRLQ

SEQ ID NO: 831804 - protein, 271 aa, Homo sapiens
CFLENKSGAITCLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGGYPPSCYQSDGRLQ

SEQ ID NO: 831805 - protein, 170 aa, Homo sapiens; identical to SEQ ID NO: 831793

SEQ ID NO: 831806 - protein, 170 aa, Homo sapiens; identical to SEQ ID NO: 831793

SEQ ID NO: 831807 - protein, 129 aa, Homo sapiens
LPLPLPLFLLLPRRRRRRRRLSLRLSRRPLPPARGGMDDQSRMLQTLAGVNLAGHSVQGGMALPPPPHGHEGADGDGRKQDIGDILHQIMTITDQSLDEAQANLECSLTTSEQYSRCSLSLSYLFASCN

SEQ ID NO: 831808 - protein, 92 aa, Homo sapiens
MAYRGQGQKVQKVMVQPINLIFRYLQNRSRIQVWLYEQVNMRIEGCIIGFDEYMNLVLDDAEEIHSKTKSRKQLGRIMLKGDNITLLQSVSN

SEQ ID NO: 831809 - protein, 92 aa, Homo sapiens; identical to SEQ ID NO: 831808

SEQ ID NO: 831810 - protein, 68 aa, Homo sapiens
SGSLFRKLLSEAACGCALCEIPPWRTVARVRKCRRLWCSPSYPTQDVRTRRFGSEYGVRRRRLRAGLG

SEQ ID NO: 831811 - protein, 68 aa, Homo sapiens; identical to SEQ ID NO: 831810

SEQ ID NO: 831812 - protein, 68 aa, Homo sapiens; identical to SEQ ID NO: 831810

SEQ ID NO: 831813 - protein, 104 aa, Homo sapiens
MAYRGQGQKVQKVMVQPINLIFRYLQNRSRIQVWLYEQVNMRIEGCIINDQSMGEMQIIGGDDLSTLAGKKTLGRRDSSDDWEIPDGQITVGQRIGSGSFGTVY

SEQ ID NO: 831814 - protein, 68 aa, Homo sapiens; identical to SEQ ID NO: 831810

SEQ ID NO: 831815 - protein, 92 aa, Homo sapiens; identical to SEQ ID NO: 831808

SEQ ID NO: 831816 - protein, 92 aa, Homo sapiens; identical to SEQ ID NO: 831808

SEQ ID NO: 831817 - protein, 735 aa, Homo sapiens
CGPRLPFKRAGPAPAAPHRGDQEARWFSGAAPSRLPPAPRFSGPAAIFLSAQGPPSGAMQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEEAGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 831818 - protein, 767 aa, Homo sapiens
AAPACPLKERGLRRPRHTAGTRRHAGFPGPLHRAFLLRLASPVQPPSSFPHRGRRAGPCSQRCFSASWEPWGWRSFICRRYYRFPAERESAEMGVFSSSHLEDEENTVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEEAGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 831819 - protein, 716 aa, Homo sapiens
CGPRLPFKRAGPAPAAPHRGDQEARWFSGAAPSRLPPAPRFSGPAAIFLSAQGPPSGAMQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEEAGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKFSQRG

SEQ ID NO: 831820 - protein, 574 aa, Homo sapiens
CGPRLPFKRAGPAPAAPHRGDQEARWFSGAAPSRLPPAPRFSGPAAIFLSAQGPPSGAMQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEEAGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRANPVGTRQETDGQRPRARNPGRKAPNGVKRTTHTERTREYTTPRLRAHRQKTHPDRRSHPPTRTKRNGTRTVNSMSANPATQPHHAPPP

SEQ ID NO: 831821 - protein, 174 aa, Homo sapiens
CGPRLPFKRAGPAPAAPHRGDQEARWFSGAAPSRLPPAPRFSGPAAIFLSAQGPPSGAMQPTLLLSLLGAVGLAAVNSMPVDNRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 831822 - protein, 717 aa, Homo sapiens
CGPRLPFKRAGPAPAAPHRGDQEARWFSGAAPSRLPPAPRFSGPAAIFLSAQGPPSGAMQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEEAGSQENHPQESKGQPRSQEESEEGEEDATSEVDKRRTRPRHHHGRSRPDRSSQGGSLPSEEKGHPQEESEESNVSMASLGDGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 831823 - protein, 735 aa, Homo sapiens; identical to SEQ ID NO: 831817

SEQ ID NO: 831824 - protein, 348 aa, Homo sapiens
CGPRLPFKRAGPAPAAPHRGDQEARWFSGAAPSRLPPAPRFSGPAAIFLSAQGPPSGAMQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 831825 - protein, 71 aa, Homo sapiens
MKDSASAASAGAELVLRRFPWAFLVRRPLLPPPETLPDRWLQAAEEEEVELLPFPRSRHCTLAWGTERDSV

SEQ ID NO: 831826 - protein, 1925 aa, Homo sapiens
MKDSASAASAGAELVLRRFPWAFLVRRPLLPPPETLPDRWLQAAEEEEVELLPFRSPPREENVPEILDRKHFDQEGMCIYYTKFQGPSQMPSRMSNLSATRQVFLGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPPQPSCKSHLETGTKDQETVCSKATEGDNTEFGAFVGHRDSMDLQRFKETSNKIKILSNNNTSENTLKRASSLAGFTDCHRTSIPVHSEQEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 831827 - protein, 1925 aa, Homo sapiens; identical to SEQ ID NO: 831826

SEQ ID NO: 831828 - protein, 1577 aa, Homo sapiens
MKDSASAASAGAELVLRRFPWAFLVRRPLLPPPETLPDRWLQAAEEEEVELLPFRSPPREENVPEILDRKHFDQEGMCIYYTKFQGPSQMPSRMSNLSATRQVFLGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPPQPSCKSHLETGTKDQETVCSKATEGDNTEFGAFVGHRDSMDLQRFKETSNKIKILSNNNTSENTLKRASSLAGFTDCHRTSIPVHSEQAEKKSRRGREFSSSSSSSRRP

SEQ ID NO: 831829 - protein, 865 aa, Homo sapiens
MFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPPQPSCKSHLETGTKDQETVCSKATEGDNTEFGAFVGHRDSMDLQRFKETSNKIKILSNNNTSENTLKRASSLAGFTDCHRTSIPVHSEQEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 831830 - protein, 1907 aa, Homo sapiens
MKDSASAASAGAELVLRRFPWAFLVRRPLLPPPETLPDRWLQAAEEEEVELLPFRSPPREENVPEILDRKHFDQEGMCIYYTKFQGPSQMPSRMSNLSATRQVFLGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQFFVSTPPQPSCKSHLETGTKDQETVCSKATEGDNTEFGAFVGHRDSMDLQRFKETSNKIKILSNNNTSENTLKRASSLAGFTDCHRTSIPVHSEQEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 831831 - protein, 1598 aa, Homo sapiens
MKDSASAASAGAELVLRRFPWAFLVRRPLLPPPETLPDRWLQAAEEEEVELLPFRSPPREENVPEILDRKHFDQEGMCIYYTKFQGPSQMPSRMSNLSATRQVFLGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPPQPSCKSHLETGTKDQETVCSKATEGDNTEFGAFVGHRDSMDLQRFKETSNKIKILSNNNTSENTLKRASSLAGFTDCHRTSIPVHSEQEKISRRPSTEDTHEVDSKAALIPVCRFQLNRYILLNTLNFFR

SEQ ID NO: 831832 - protein, 1059 aa, Homo sapiens
MKDSASAASAGAELVLRRFPWAFLVRRPLLPPPETLPDRWLQAAEEEEVELLPFRSPPREENVPEILDRKHFDQEGMCIYYTKFQGPSQMPSRMSNLSATRQVFLGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVS

SEQ ID NO: 831833 - protein, 331 aa, Homo sapiens
MKDSASAASAGAELVLRRFPWAFLVRRPLLPPPETLPDRWLQAAEEEEVELLPFRSPPREENVPEILDRKHFDQEGMCIYYTKFQGPSQMPSRMSNLSATRQVFLGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRWCGLRWC

SEQ ID NO: 831834 - protein, 1925 aa, Homo sapiens; identical to SEQ ID NO: 831826

SEQ ID NO: 831835 - protein, 1750 aa, Homo sapiens
MKDSASAASAGAELVLRRFPWAFLVRRPLLPPPETLPDRWLQAAEEEEVELLPFRSPPREENVPEILDRKHFDQEGMCIYYTKFQGPSQMPSRMSNLSATRQVFLGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPPQPSCKSHLETGTKDQETVCSKATEGDNTEFGAFVGHRDSMDLQRFKETSNKIKILSNNNTSENTLKRASSLAGFTDCHRTSIPVHSEQEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLRVSVSEYLIVEHNLSFIF

SEQ ID NO: 831836 - protein, 1925 aa, Homo sapiens; identical to SEQ ID NO: 831826

SEQ ID NO: 831837 - protein, 1591 aa, Homo sapiens
MKDSASAASAGAELVLRRFPWAFLVRRPLLPPPETLPDRWLQAAEEEEVELLPFRSPPREENVPEILDRKHFDQEGMCIYYTKFQGPSQMPSRMSNLSATRQVFLGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPPQPSCKSHLETGTKDQETVCSKATEGDNTEFGAFVGHRDSMDLQRFKETSNKIKILSNNNTSENTLKRASSLAGFTDCHRTSIPVHSEQEKISRRPSTEDTHEVDSKAALIPDWLQDRPSNREM

SEQ ID NO: 831838 - protein, 435 aa, Homo sapiens
MSAQYLQNNNTSENTLKRASSLAGFTDCHRTSIPVHSEQEKISRRPSTEDTHEVDSKAALIPDWLQDRPSNREMPSEEGTLNGLTSPFKPAMDTNYYYSGQYILKTKFNSILDLYRFNYFSLIFDAAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 831839 - protein, 286 aa, Homo sapiens
MLKSCSRASFSPSVRKPPLILRRLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGVGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFIRYS

SEQ ID NO: 831840 - protein, 355 aa, Homo sapiens
MLKSCSRASFSPSVRKPPLILRRLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGSGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 831841 - protein, 822 aa, Homo sapiens
ALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEIPELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKGDTRSSFESPAQDQSWMFLGHSEVGDPSLDARDSGPGWSGKTVEPFSELGLGEGPQLQILEEMKPLESLALEEASGPVSQSQKSKSRGRAGPDAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGSGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 831842 - protein, 593 aa, Homo sapiens
ALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEIPELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKGDTRSSFESPAQDQSWMFLGHSEVGDPSLDARDSGPGWSGKTVEPFSELGLGEGPQLQILEEMKPLESLALEEASGPVSQSQKSKSRGRAGPDAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHGKSLSWQGQS

SEQ ID NO: 831843 - protein, 694 aa, Homo sapiens
ALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEIPELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKGDTRSSFESPAQDQSWMFLGHSEVGDPSLDARDSGPGWSGKTVEPFSELGLGEGPQLQILEEMKPLESLALEEASGPVSQSQKSKSRGRAGPDAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGSGYYGDGLNAIIVFAACFLPDSSRADYHYVMENLFLYCHKYFRAVGAQILYS

SEQ ID NO: 831844 - protein, 822 aa, Homo sapiens; identical to SEQ ID NO: 831841

SEQ ID NO: 831845 - protein, 30 aa, Homo sapiens
MKVIEPYRRVISHGGQEIQVTFSEVLLDKG

SEQ ID NO: 831846 - protein, 484 aa, Homo sapiens
ALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEIPELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKGDTRSSFESPAQDQSWMFLGHSEVGDPSLDARDSGPGWSGKTVEPFSELGLGEGPQLQILEEMKPLESLALEEASGPVSQSQKSKSRGRAGPDAVTHDNEWEMLSPQPVQKNMIPSFRTCPHTRSSALFPP

SEQ ID NO: 831847 - protein, 813 aa, Homo sapiens
ALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEIPELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKGDTRSSFESPAQDQSWMFLGHSEVGDPSLDARDSGPGWSGKTVEPFSELGLGEGPQLQILEEMKPLESLALEEASGPVSQSQKSKSRGRAGPDAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGSGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKE

SEQ ID NO: 831848 - protein, 753 aa, Homo sapiens
ALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEIPELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKGDTRSSFESPAQDQSWMFLGHSEVGDPSLDARDSGPGWSGKTVEPFSELGLGEGPQLQILEEMKPLESLALEEASGPVSQSQKSKSRGRAGPDAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGSGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFIRYS

SEQ ID NO: 831849 - protein, 533 aa, Homo sapiens
LRVRGLPGASCTLAPDGVNSWWCPPTTTRCLNHHDDDDVIVVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEEPLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 831850 - protein, 179 aa, Homo sapiens
PFPCCLHDGKYWRFSEGRGSRPQGPFLIADKWPALPRKLDSVFEEPLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 831851 - protein, 524 aa, Homo sapiens
DTSALTMSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAMFPGVPLDTHDVFQYREKAYFCQDRFYWRVSSRSELNQVDQVGYVTYDILQCPED

SEQ ID NO: 831852 - protein, 494 aa, Homo sapiens
DTSALTMSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTALPSNRVHGQMLTPDTPHIWPQLFPY

SEQ ID NO: 831853 - protein, 314 aa, Homo sapiens
DTSALTMSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQEEGVCQEPVLPVEGIPVSVLRDTKLDDDV

SEQ ID NO: 831854 - protein, 96 aa, Homo sapiens
SPARPPQLKQPGKSISNWEVMERLKGMVQNHQFSTLRISKSTMDFIRFEGEVENKSLEKAYFCQDRFYWRVSSRSELNQVDQVGYVTYDILQCPED

SEQ ID NO: 831855 - protein, 713 aa, Homo sapiens
DTSALTMSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEEPLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 831856 - protein, 444 aa, Homo sapiens
MTSCGPWARASWFQLGLETQMARPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEEPLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 831857 - protein, 572 aa, Homo sapiens
DTSALTMSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGCSPGCLWTRTTSSSTERKPISARTASTGA

SEQ ID NO: 831858 - protein, 473 aa, Homo sapiens
DTSALTMSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTTTGSSRTPH

SEQ ID NO: 831859 - protein, 95 aa, Homo sapiens
ARAPSVRPLAGSAPVSSAPARRFDVKAQMVDPRSASEVDRMFPGVPLDTHDVFQYREKAYFCQDRFYWRVSSRSELNQVDQVGYVTYDILQCPED

SEQ ID NO: 831860 - protein, 151 aa, Homo sapiens
LFFKDLTINLINNLYVIVIIPDFKKQELASSCFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISRSRNWPVPAS

SEQ ID NO: 831861 - protein, 3432 aa, Homo sapiens
MAKYGEHEASPDNGQNEFSDIIKSRSDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831862 - protein, 3432 aa, Homo sapiens; identical to SEQ ID NO: 831861

SEQ ID NO: 831863 - protein, 3432 aa, Homo sapiens; identical to SEQ ID NO: 831861

SEQ ID NO: 831864 - protein, 3491 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQVRSQRSGKWRNSMCSSRVKEGFSYHELEVNAALINFLLRMFIFSELCDRIFSSLRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831865 - protein, 2891 aa, Homo sapiens
MGRKLVFDFFNIIRNIILLLESVLSRKQPGQHFLQRNLIAVQIHVNLMTVLGVSDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831866 - protein, 2576 aa, Homo sapiens
MARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831867 - protein, 1473 aa, Homo sapiens
MQQHSTSFKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831868 - protein, 3424 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGSWRWYRMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831869 - protein, 3307 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGSWRWYRMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGWRLGCRF

SEQ ID NO: 831870 - protein, 1078 aa, Homo sapiens
MRLDSIFFSKPDGIHSPNKFLCPILLQELGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831871 - protein, 372 aa, Homo sapiens
MVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831872 - protein, 345 aa, Homo sapiens
MLEEEEWYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831873 - protein, 3457 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGSWRWYRMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCREYERLQHHSCTCSFPFSFSACGPSPSSLR

SEQ ID NO: 831874 - protein, 2395 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPISFEMGPDFITGE

SEQ ID NO: 831875 - protein, 2420 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPISMKWAQKLFGLCGASCLAEKAILGSRESENGKNLRDT

SEQ ID NO: 831876 - protein, 2421 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPISMKWAQKFSTCLDSIGLAELRDHRSAFYGVEFLLKISL

SEQ ID NO: 831877 - protein, 2199 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISRSRKLASSCFLKFYKAELKMLLEDGCVGVEEGS

SEQ ID NO: 831878 - protein, 252 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPDLECLPVQPSLEQRKSH

SEQ ID NO: 831879 - protein, 107 aa, Homo sapiens
MRTAITEKLERVKNQWDGTQHGVELRQQQLEDMIIDSLQWDDHREETEELMRKYEARLYILQQARRDPLTKQISVPISMKWAQKFPMYFPHTGTASLIISIPHQSGC

SEQ ID NO: 831880 - protein, 3432 aa, Homo sapiens; identical to SEQ ID NO: 831861

SEQ ID NO: 831881 - protein, 3432 aa, Homo sapiens; identical to SEQ ID NO: 831861

SEQ ID NO: 831882 - protein, 3437 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGSWRWYRMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831883 - protein, 2392 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDHRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831884 - protein, 1710 aa, Homo sapiens
RGPPTYSSLSKDRNLETVSQRIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831885 - protein, 1412 aa, Homo sapiens
LFFKDLTINLINNLYVIVIIPDFKKQELASSCFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831886 - protein, 1287 aa, Homo sapiens
MLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831887 - protein, 385 aa, Homo sapiens
MVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831888 - protein, 278 aa, Homo sapiens
TFVSLSPLCSPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 831889 - protein, 3046 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGSWRWYRMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQVSMKDHWCVGCVGEGF

SEQ ID NO: 831890 - protein, 2836 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTWAQKLKNKASSSDMRTAITEKLERVKNQWDGTQHGVELRQQQLEDMIIDSLQWDDHREETEELMRKYEARLYILQQARRDPLTKQISVPNTASRTGSWRWYRMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYIK

SEQ ID NO: 831891 - protein, 2176 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELESAQIEEVLQRGEEMYINHEIGPSSIR

SEQ ID NO: 831892 - protein, 138 aa, Homo sapiens
MENMKPVLTMGRTNSVISLSPDLPSPTTGERDNGPLLLIPHSDQIPQLQSPAIGLHHQLNLIDKRFHHVAQAGLKLLGSSNPSTSASRSVGITGVSHHARLTLPTLALRKLKQTKEESRNFNTTSILNQNPPLALPYA

SEQ ID NO: 831893 - protein, 144 aa, Homo sapiens
MDIIETAKLEEHLENQPSDPTNTYARPAEPVEEENKNGNGKPKSLSSGLRKGTKKYPDYIQIAMPTESRNKFPLEWWKTGIAFIYAVFNLVLTTVMITVVHERVPPKELSPPLPDKFFDYIDRVKWAFSVSEINGIILVGLWIT

SEQ ID NO: 831894 - protein, 144 aa, Homo sapiens; identical to SEQ ID NO: 831893

SEQ ID NO: 831895 - protein, 144 aa, Homo sapiens; identical to SEQ ID NO: 831893

SEQ ID NO: 831896 - protein, 490 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTDAAQTLALAQDHSMDIPSQDQLKQSAEESSTSRKRTTEDDIPTLPTSEHKCIHSREDEDLIENLAQDETSRLDLGFEEWDVAGLPWWFLGNLRSNYTPRSNGSTDLQTNQDVGTAIVSDTTDDLWFLNESVSEQLGVGIKVEAADTEQTSEEVGKVSDKKVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 831897 - protein, 490 aa, Homo sapiens; identical to SEQ ID NO: 831896

SEQ ID NO: 831898 - protein, 140 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTAKCRGKFHFQKKNYRRRYPHTAYLRA

SEQ ID NO: 831899 - protein, 490 aa, Homo sapiens; identical to SEQ ID NO: 831896

SEQ ID NO: 831900 - protein, 490 aa, Homo sapiens; identical to SEQ ID NO: 831896

SEQ ID NO: 831901 - protein, 131 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTEMGHLFCRISHALELAD

SEQ ID NO: 831902 - protein, 107 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDRFLHCIT

SEQ ID NO: 831903 - protein, 363 aa, Homo sapiens
MDIPSQDQLKQSAEESSTSRKRTTEDDIPTLPTSEHKCIHSREDEDLIENLAQDETSRLDLGFEEWDVAGLPWWFLGNLRSNYTPRSNGSTDLQTNQDVGTAIVSDTTDDLWFLNESVSEQLGVGIKVEAADTEQTSEEVGKVSDKKVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 831904 - protein, 379 aa, Homo sapiens
MPNFVVDWRVYTDSLFLTVDFGLCAEQSAEESSTSRKRTTEDDIPTLPTSEHKCIHSREDEDLIENLAQDETSRLDLGFEEWDVAGLPWWFLGNLRSNYTPRSNGSTDLQTNQDVGTAIVSDTTDDLWFLNESVSEQLGVGIKVEAADTEQTSEEVGKVSDKKVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 831905 - protein, 490 aa, Homo sapiens; identical to SEQ ID NO: 831896

SEQ ID NO: 831906 - protein, 299 aa, Homo sapiens
VSPTGCRPPRPSGGAGQTALHALQEEQARLKMRLWDLQQLRKELGDSPKDKVPFSVPKIPLVFRGHTQQDPEVPKSLVSNLRIHCPLLAGSALITFDDPKVAEQVLQQKEHTINMEECRLRVQVQPLELPMVTTIQVMVSSQLSGRRVLVTGFPASLRLSEEELLDKLEIFFGKTRNGGGDVDVRELLPGSVMLGFARDGVAQRLCQIGQFTVPLGGQQVPLRVSPYVNGEIQKAEIRSQPVPRSVLVLNIPDILDGPELHDVLEIHFQKPTRGGGEVEALTVVPQGQQGLAVFTSESG

SEQ ID NO: 831907 - protein, 288 aa, Homo sapiens
MSAPLDAALHALQEEQARLKMRLWDLQQLRKELGDSPKDKVPFSVPKIPLVFRGHTQQDPEVPKSLVSNLRIHCPLLAGSALITFDDPKVAEQVLQQKEHTINMEECRLRVQVQPLELPMVTTIQVMVSSQLSGRRVLVTGFPASLRLSEEELLDKLEIFFGKTRNGGGDVDVRELLPGSVMLGFARDGVAQRLCQIGQFTVPLGGQQVPLRVSPYVNGEIQKAEIRSQPVPRSVLVLNIPDILDGPELHDVLEIHFQKPTRGGGEVEALTVVPQGQQGLAVFTSESG

SEQ ID NO: 831908 - protein, 320 aa, Homo sapiens
LELSINSAFGASRIGPPSPGLVDSLEGRVEVLLFPSAPTALHALQEEQARLKMRLWDLQQLRKELGDSPKDKVPFSVPKIPLVFRGHTQQDPEVPKSLVSNLRIHCPLLAGSALITFDDPKVAEQVLQQKEHTINMEECRLRVQVQPLELPMVTTIQVMVSSQLSGRRVLVTGFPASLRLSEEELLDKLEIFFGKTRNGGGDVDVRELLPGSVMLGFARDGVAQRLCQIGQFTVPLGGQQVPLRVSPYVNGEIQKAEIRSQPVPRSVLVLNIPDILDGPELHDVLEIHFQKPTRGGGEVEALTVVPQGQQGLAVFTSESG

SEQ ID NO: 831909 - protein, 288 aa, Homo sapiens; identical to SEQ ID NO: 831907

SEQ ID NO: 831910 - protein, 288 aa, Homo sapiens; identical to SEQ ID NO: 831907

SEQ ID NO: 831911 - protein, 288 aa, Homo sapiens; identical to SEQ ID NO: 831907

SEQ ID NO: 831912 - protein, 265 aa, Homo sapiens
FLLGGSEEHSYPLPYFQVPFSVPKIPLVFRGHTQQDPEVPKSLVSNLRIHCPLLAGSALITFDDPKVAEQVLQQKEHTINMEECRLRVQVQPLELPMVTTIQVMVSSQLSGRRVLVTGFPASLRLSEEELLDKLEIFFGKTRNGGGDVDVRELLPGSVMLGFARDGVAQRLCQIGQFTVPLGGQQVPLRVSPYVNGEIQKAEIRSQPVPRSVLVLNIPDILDGPELHDVLEIHFQKPTRGGGEVEALTVVPQGQQGLAVFTSESG

SEQ ID NO: 831913 - protein, 665 aa, Homo sapiens
MEVSGPEDDPFLSQLHQVQCPVCQQMMPAAHINSHLDRCLLLHPAGHAEPAAGSHRAGERAKGPSPPGAKRRRLSESSALKQPATPTAAESSEGEGEEGDDGGETESRESYDAPPTPSGARLIPDFPVARSSSPGRKGSGKRPAAAAAAGSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQDTFLPHVECGTITLIGATTENPSFQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 831914 - protein, 640 aa, Homo sapiens
MEVSGPEDDPFLSQLHQVQCPVCQQMMPAAHINSHLDRCLLLHPAGHAEPAAGSHRAGERAKGPSPPGAKRRRLSESSALKQPATPTAAESSEGEGEEGDDGGETESRESYDAPPTPSGARLIPDFPVARSSSPGRKGSGKRPAAAAAAGSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 831915 - protein, 576 aa, Homo sapiens
MEVSGPEDDPFLSQLHQVQCPVCQQMMPAAHINSHLDRCLLLHPAGHAEPAAGSHRAGERAKGPSPPGAKRRRLSESSALKQPATPTAAESSEGEGEEGDDGGETESRESYDAPPTPSGARLIPDFPVARSSSPGRKGSGKRPAAAAAAGSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQDTFLPHVECGTITLIGATTENPSFQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVK

SEQ ID NO: 831916 - protein, 206 aa, Homo sapiens
MFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 831917 - protein, 665 aa, Homo sapiens; identical to SEQ ID NO: 831913

SEQ ID NO: 831918 - protein, 497 aa, Homo sapiens
MEVSGPEDDPFLSQLHQVQCPVCQQMMPAAHINSHLDRCLLLHPAGHAEPAAGSHRAGERAKGPSPPGAKRRRLSESSALKQPATPTAAESSEGEGEEGDDGGETESRESYDAPPTPSGARLIPDFPVARSSSPGRKGSGKRPAAAAAAGSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQDTFLPHVECGTITLIGATTENPSFQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGK

SEQ ID NO: 831919 - protein, 348 aa, Homo sapiens
MATGTRTRTARTTRGTGTRTLPKPPPPSGPVAGAARTPGRWLPRRSDRCYRASRWPTRCVLTRCRITSGRARPWARIPCCARSWRPTKSPRLSCGGRRAAARPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 831920 - protein, 135 aa, Homo sapiens
GSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKVSAALAVGLP

SEQ ID NO: 831921 - protein, 240 aa, Homo sapiens
MLRSCAARLRTLGALCRPPVGRRLPGSEPRPELRSFSSEEVILKDCSVPNPSWNKDLRLLFDQFMKKCEDGSWKRLPSYKRTPTEWIQDFKTHFLDPKLMKEEQMSQAQLFTRSFDDGLGFEYVMFYNDIEKRMVCLFQGGPYLEGPPGFIHGGAIATMIDATVGMCAMMAGGIVMTANLNINYKRPIPLCSVVMINSQLDKVEGRKFFVSCNVQSVDEKTLYSEATSLFIKLNPAKSLT

SEQ ID NO: 831922 - protein, 240 aa, Homo sapiens; identical to SEQ ID NO: 831921

SEQ ID NO: 831923 - protein, 208 aa, Homo sapiens
MRSFSSEEVILKDCSVPNPSWNKDLRLLFDQFMKKCEDGSWKRLPSYKRTPTEWIQDFKTHFLDPKLMKEEQMSQAQLFTRSFDDGLGFEYVMFYNDIEKRMVCLFQGGPYLEGPPGFIHGGAIATMIDATVGMCAMMAGGIVMTANLNINYKRPIPLCSVVMINSQLDKVEGRKFFVSCNVQSVDEKTLYSEATSLFIKLNPAKSLT

SEQ ID NO: 831924 - protein, 240 aa, Homo sapiens; identical to SEQ ID NO: 831921

SEQ ID NO: 831925 - protein, 240 aa, Homo sapiens; identical to SEQ ID NO: 831921

SEQ ID NO: 831926 - protein, 154 aa, Homo sapiens
MKEEQMSQAQLFTRSFDDGLGFEYVMFYNDIEKRMVCLFQGGPYLEGPPGFIHGGAIATMIDATVGMCAMMAGGIVMTANLNINYKRPIPLCSVVMINSQLDKVEGRKFFVSCNVQSVDEKTLYSEATSGISRSTAAASWLARHPGKKKKGKKI

SEQ ID NO: 831927 - protein, 141 aa, Homo sapiens
MKEEQMSQAQLFTRSFDDGLGFEYVMFYNDIEKRMVCLFQGGPYLEGPPGFIHGGAIATMIDATVGMCAMMAGGIVMTANLNINYKRPIPLCSVVMINSQLDKVEGRKFFVSCNVQSVDEKTLYSEATSLFIKLNPAKSLT

SEQ ID NO: 831928 - protein, 141 aa, Homo sapiens; identical to SEQ ID NO: 831927

SEQ ID NO: 831929 - protein, 141 aa, Homo sapiens; identical to SEQ ID NO: 831927

SEQ ID NO: 831930 - protein, 110 aa, Homo sapiens [sequence omitted]

SEQ ID NO: 831931 - protein, 704 aa, Homo sapiens
LRRALRHRTTAAPPMKRLPLLVVFSTWLNCSYTQNCTKTPCLPNAKCEIRNGIEACYCNMGFSGNGVTICEDDNECGNLTQSCGENANCTNTEGSYYCMCVPGFRSSSNQDRFITNDGTVCIENVNANCHLDNVCIAANINKTLTKIRSIKEPVALLQEVYRNSVTDLSPTDIITYIEILAESSSLLGYKNNTISAKDTLSNSTLTEFVKTVNNFVQRDTFVVWDKLSVNHRRTHLTKLMHTVEQATLRISQSFQKTTEFDTNSTDIALKVFFFDSYNMKHIHPHMNMDGDYINIFPKRKAAYDSNGNVAVAFLYYKSIGPLLSSSDNFLLKPQNYDNSEEEERVISSVISVSMSSNPPTLYELEKITFTLSHRKVTDRYRSLCAFWNYSPDTMNGSWSSEGCELTYSNETHTSCRCNHLTHFAILMSSGPSIGIKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLR

SEQ ID NO: 831932 - protein, 705 aa, Homo sapiens
LRRALRHRTTAAPPMKRLPLLVVFSTWLNCSYTQNCTKTPCLPNAKCEIRNGIEACYCNMGFSGNGVTICEDDNECGNLTQSCGENANCTNTEGSYYCMCVPGFRSSSNQDRFITNDGTVCIENVNANCHLDNVCIAANINKTLTKIRSIKEPVALLQEVYRNSVTDLSPTDIITYIEILAESSSLLGYKNNTISAKDTLSNSTLTEFVKTVNNFVQRDTFVVWDKLSVNHRRTHLTKLMHTVEQATLRISQSFQKTTEFDTNSTDIALKVFFFDSYNMKHIHPHMNMDGDYINIFPKRKAAYDSNGNVAVAFLYYKSIGPLLSSSDNFLLKPQNYDNSEEEERVISSVISVSMSSNPPTLYELEKITFTLSHRKVTDRYRSLCAFWNYSPDTMNGSWSSEGCELTYSNETHTSCRCNHLTHFAILMSSGPSIGIKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLSC

SEQ ID NO: 831933 - protein, 260 aa, Homo sapiens
IGPRRSPPSARPRPRGKEPGRTLGRSDAARGGGRGLVCGPLSAPRGSRRPTVPGTPACLARPAAQGFSAALPVRWTGRRAGPSRPVPIGTPSRAADPSQGEMSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNEKLNLRQRPNKKPPRKQPPSFPGPPA

SEQ ID NO: 831934 - protein, 459 aa, Homo sapiens
IGPRRSPPSARPRPRGKEPGRTLGRSDAARGGGRGLVCGPLSAPRGSRRPTVPGTPACLARPAAQGFSAALPVRWTGRRAGPSRPVPIGTPSRAADPSQGEMSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 831935 - protein, 446 aa, Homo sapiens
TPPARASKNIARSRPGVNSGRGLVCGPLSAPRGSRRPTVPGTPACLARPAAQGFSAALPVRWTGRRAGPSRPVPIGTPSRAADPSQGEMSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 831936 - protein, 360 aa, Homo sapiens
IGPRRSPPSARPRPRGKEPGRTLGRSDAARGGGRGLVCGPLSAPRGSRRPTVPGTPACLARPAAQGFSAALPVRWTGRRAGPSRPVPIGTPSRAADPSQGEMSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNALPSSPM

SEQ ID NO: 831937 - protein, 370 aa, Homo sapiens
IGPRRSPPSARPRPRGKEPGRTLGRSDAARGGGRGLVCGPLSAPRGSRRPTVPGTPACLARPAAQGFSAALPVRWTGRRAGPSRPVPIGTPSRAADPSQGEMSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVDGSAGWERWGRGAARAAGGPCAGAGAGVQSGGLGAEPLLRGSGAPMLTPGSRRNRSLQYGPGLALRP

SEQ ID NO: 831938 - protein, 85 aa, Homo sapiens
FGGLSWEFSSSLVSLEADLTRAGLGLSKAASAQDSTAPSSTSSSDPILDFNISLAMAKERAHQKRSSKRAPQMDWSKKNELFSNL

SEQ ID NO: 831939 - protein, 238 aa, Homo sapiens
MSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVYGGLLGGAPLRPVGPATGGGPAPARVWRGTRILPTS

SEQ ID NO: 831940 - protein, 248 aa, Homo sapiens
HTKVLRLPSPAARAHWGGPVPFWRNPRPEAPRRGDGPWKSLAGSGHWEVGYRLTLISQVHGNQVTQIIPFSTEGETKAQRSPSLPPRDLIRGRHSWNLDSTQLLGYCPLLPPPLHPAGPLPVPFTNGEIQKENSREALAEAALESPRPALVRSASSDTSEELNSQDSPPKQDSTAPSSTSSSDPILDFNISLAMAKERAHQKRSSKRAPQMDWSKKNENIQKTLRSQMTRPGDRQGETEYNPAITLTE

SEQ ID NO: 831941 - protein, 358 aa, Homo sapiens
MSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 831942 - protein, 468 aa, Homo sapiens
IGPRRSPPSARPRPRGKEPGRTLGRSDAARGGGRGLVCGPLSAPRGSRRPTVPGTPACLARPAAQGFSAALPVRWTGRRAGPSRPVPIGTPSRAADPSQGEMSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKGRASIPPHLFPSPQLLP

SEQ ID NO: 831943 - protein, 340 aa, Homo sapiens
IGPRRSPPSARPRPRGKEPGRTLGRSDAARGGGRGLVCGPLSAPRGSRRPTVPGTPACLARPAAQGFSAALPVRWTGRRAGPSRPVPIGTPSRAADPSQGEMSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 831944 - protein, 339 aa, Homo sapiens
IGPRRSPPSARPRPRGKEPGRTLGRSDAARGGGRGLVCGPLSAPRGSRRPTVPGTPACLARPAAQGFSAALPVRWTGRRAGPSRPVPIGTPSRAADPSQGEMSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVYGGLLGGAPLRPVGPATGGGPAPARVWRGTRILPTS

SEQ ID NO: 831945 - protein, 590 aa, Homo sapiens
GRDREHRPLRGRFGSSRDPTLSQPAQPAAAASAPRRQLSICTSLREPRERCAATMFSWLKRGGARGQQPEAIRTVTSALKELYRTKLLPLEEHYRFGAFHSPALEDADFDGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLCDYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 831946 - protein, 597 aa, Homo sapiens
GRDREHRPLRGRFGSSRDPTLSQPAQPAAAASAPRRQLSICTSLREPRERCAATMFSWLKRGGARGQQPEAIRTVTSALKELYRTKLLPLEEHYRFGAFHSPALEDADFDGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 831947 - protein, 597 aa, Homo sapiens; identical to SEQ ID NO: 831946

SEQ ID NO: 831948 - protein, 269 aa, Homo sapiens
WNITCKKRLVGRIRDCDQLDDLNAVFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDACWMMRSSRWPATSSRPSWKATGCPPTCPVAWCHPPSDATRAPPRDPMEKMGKSKIHGDDAPSRMLAGIPTPTTVPHPMAGRGL

SEQ ID NO: 831949 - protein, 386 aa, Homo sapiens
GRDREHRPLRGRFGSSRDPTLSQPAQPAAAASAPRRQLSICTSLREPRERCAATMFSWLKRGGARGQQPEAIRTVTSALKELYRTKLLPLEEHYRFGAFHSPALEDADFDGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRMESLSITQAGEQWHDLGSLQPLPPRLK

SEQ ID NO: 831950 - protein, 597 aa, Homo sapiens; identical to SEQ ID NO: 831946

SEQ ID NO: 831951 - protein, 513 aa, Homo sapiens
TCLRNPSPTWQLYLHSEPRPNAAQLLGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 831952 - protein, 597 aa, Homo sapiens; identical to SEQ ID NO: 831946

SEQ ID NO: 831953 - protein, 636 aa, Homo sapiens
GRDREHRPLRGRFGSSRDPTLSQPAQPAAAASAPRRQLSICTSLREPRERCAATMFSWLKRGGARGQQPEAIRTVTSALKELYRTKLLPLEEHYRFGAFHSPALEDADFDGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDACWMMRSSRWPATSSRPSWKATGCPPTCPVAWCHPPSDATRAPPRDPMEKMGKSKIHGDDAPSRMLAGIPTPTTVPHPMAGRGL

SEQ ID NO: 831954 - protein, 1291 aa, Homo sapiens
MSTKFAIPCALILHCFFKRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNSSLVVRKEPDVPVFFPSGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 831955 - protein, 1097 aa, Homo sapiens
MSTKFAIPCALILHCFFKRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNSSLVVRKEPDVPVFFPSGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 831956 - protein, 1274 aa, Homo sapiens
MSTKFAIPCALILHCFFKRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 831957 - protein, 810 aa, Homo sapiens
MSTKFAIPCALILHCFFKRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGVSHCAQLYCIF

SEQ ID NO: 831958 - protein, 1287 aa, Homo sapiens
MEPIYPFARPQMNTRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNSSLVVRKEPDVPVFFPSGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 831959 - protein, 238 aa, Homo sapiens
MSTKFAIPCALILHCFFKRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYG

SEQ ID NO: 831960 - protein, 91 aa, Homo sapiens
TLQPIVAFMVPMPAAVTHGSQHSLHPLPFAQATCTNLHTCLRPAFTAVSTTIPQQGVRLVQRGPTSGGLASVATKHLEHLRLLHIYLPSPE

SEQ ID NO: 831961 - protein, 710 aa, Homo sapiens
MLSLQYPDVYRDETAVQDYHGHKICDPYAWLEDPDSEQTKAFVEAQNKITVPFLEQCPIRGLYKERMTELYDYPKYSCHFKKGKRYFYFYNTGLQNQRVLYVQDSLEGEARVFLDPNILSDDGTVALRGYAFSEDGEYFAYGLSASGSDWVTIKFMKVDGAKELPDVLERVKFSCMAWTHDGKGMFYNSYPQQDGKSDGTETSTNLHQKLYYHVLGTDQSEDILCAEFPDEPKWMGGAELSDDGRYVLLSIREGCDPVNRLWYCDLQQESSGIAGILKWVKLIDNFEGEYDYVTNEGTVFTFKTNRQSPNYRVINIDFRDPEESKWKVLVPEHEKDVLEWIACVRSNFLVLCYLHDVKNILQLHDLTTGALLKTFPLDVGSIVGYSGQKKDTEIFYQFTSFLSPGIIYHCDLTKEELEPRVFREVTVKGIDASDYQTVQIFYPSKDGTKIPMFIVHKKGIKLDGSHPAFLYGYGGFNISITPNYSVSRLIFVRHMGGILAVANIRGGGEYGETWHKGGILANKQNCFDDFQCAAEYLIKEGYTSPKRLTINGGSNGGLLVAACANQRPDLFGCVIAQVGVMDMLKFHKYTIGHAWTTDYGCSDSKQHFEWLVKYSPLHNVKLPEADDIQYPSMLLLTADHDDRVVPLHSLKFIATLQYIVGRSRKQSNPLLIHVDTKAGHGAGKPTAKVIEEVSDMFAFIARCLNVDWIP

SEQ ID NO: 831962 - protein, 710 aa, Homo sapiens; identical to SEQ ID NO: 831961

SEQ ID NO: 831963 - protein, 259 aa, Homo sapiens [sequence omitted]

SEQ ID NO: 831964 - protein, 101 aa, Homo sapiens
MLSLQYPDVYRDETAVQDYHGHKICDPYAWLEDPDSEQTKAFVEAQNKITVPFLEQCPIRGLYKERMTELYDYPKYSCHFKKGKRVIFYTNNRVLAGTQAE

SEQ ID NO: 831965 - protein, 710 aa, Homo sapiens; identical to SEQ ID NO: 831961

SEQ ID NO: 831966 - protein, 449 aa, Homo sapiens
MLSLQYPDVYRDETAVQDYHGHKICDPYAWLEDPDSEQTKAFVEAQNKITVPFLEQCPIRGLYKERMTELYDYPKYSCHFKKGKRYFYFYNTGLQNQRVLYVQDSLEGEARVFLDPNILSDDGTVALRGYAFSEDGEYFAYGLSASGSDWVTIKFMKVDGAKELPDVLERVKFSCMAWTHDGKGMFYNSYPQQDGKSDGTETSTNLHQKLYYHVLGTDQSEDILCAEFPDEPKWMGGAELSDDGRYVLLSIREGCDPVNRLWYCDLQQESSGIAGILKWVKLIDNFEGEYDYVTNEGTVFTFKTNRQSPNYRVINIDFRDPEESKWKVLVPEHEKDVLEWIACVRSNFLVLCYLHDVKNILQLHDLTTGALLKTFPLDVGSIVGYSGQKKDTEIFYQFTSFLSPGIIYHCDLTKEELEPRVFREVTVKGIDASDYQTVQLPKGTESSRN

SEQ ID NO: 831967 - protein, 224 aa, Homo sapiens
LENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 831968 - protein, 525 aa, Homo sapiens [sequence omitted]

SEQ ID NO: 831969 - protein, 525 aa, Homo sapiens [sequence omitted]

SEQ ID NO: 831970 - protein, 525 aa, Homo sapiens [sequence omitted]

SEQ ID NO: 831971 - protein, 525 aa, Homo sapiens [sequence omitted]

SEQ ID NO: 831972 - protein, 200 aa, Homo sapiens
SLLRSHKNEKKFEEIDRKHSELSELNVKVLEALELYNKLVNEAPVYSVYSKLHPPAHYPPASSGVPMQTYPVQSHGGNYMGQSIHQVTVAQSYSLGPDQIGPLRSLPPNVNSSVTAQPAQTSYLSTGQDTVSNPTYMNQNSNLQSATGTTAYTQQMGMSVDMSSYQNTTSNLPQLAGFPVTVPAHPVAQQHTNYHQQPLL

SEQ ID NO: 831973 - protein, 114 aa, Homo sapiens
MPLFTANPFEQDVEKATNEYNTTEDWSLIMDICDKVGSTPNGAKDCLKAIMKRVNHKVPHVALQALTLLGACVANCGKIFHLEVCSRDAKVSHTYKQYEIGGLKYYFKETTVSP

SEQ ID NO: 831974 - protein, 342 aa, Homo sapiens
MPLFTANPFEQDVEKATNEYNTTEDWSLIMDICDKVGSTPNGAKDCLKAIMKRVNHKVPHVALQALTLLGACVANCGKIFHLEVCSRDFATEVRAVIKNKAHPKVCEKLKSLMVEWSEEFQKDPQFSLISATIKSMKEEGITFPPAGSQTVSAAAKNGTSSNKNKEDEDIAKAIELSLQEQKQQHTETKSLYPSSEIQLNNKVARKVRALYDFEAVEDNELTFKHGEIIIVLDDSDANWWKGENHRGIGLFPSNFVTTNLNIETEAAAVDKLNVIDDDVEEIKKSEPEPVYIDEDKMDRALQVLQSIDPTDSKPDSQDLLDLEDICQQMGPMIDEKLEEIDR

SEQ ID NO: 831975 - protein, 525 aa, Homo sapiens [sequence omitted]

SEQ ID NO: 831976 - protein, 535 aa, Homo sapiens
MPLFTANPFEQDVEKATNEYNTTEDWSLIMDICDKVGSTPNGAKDCLKAIMKRVNHKVPHVALQALTLLGACVANCGKIFHLEVCSRDFATEVRAVIKNKAHPKVCEKLKSLMVEWSEEFQKDPQFSLISATIKSMKEEGITFPPAGSQGWARWLTPVIPALWEAEVGSIMRSRDRDQPDQQAIELSLQEQKQQHTETKSLYPSSEIQLNNKVARKVRALYDFEAVEDNELTFKHGEIIIVLDDSDANWWKGENHRGIGLFPSNFVTTNLNIETEAAAVDKLNVIDDDVEEIKKSEPEPVYIDEDKMDRALQVLQSIDPTDSKPDSQDLLDLEDICQQMGPMIDEKLEEIDRKHSELSELNVKVLEALELYNKLVNEAPVYSVYSKLHPPAHYPPASSGVPMQTYPVQSHGGNYMGQSIHQVTVAQSYSLGPDQIGPLRSLPPNVNSSVTAQPAQTSYLSTGQDTVSNPTYMNQNSNLQSATGTTAYTQQMGMSVDMSSYQNTTSNLPQLAGFPVTVPAHPVAQQHTNYHQQPLL

SEQ ID NO: 831977 - protein, 235 aa, Homo sapiens
MPLFTANPFEQDVEKATNEYNTTEDWSLIMDICDKVGSTPNGAKDCLKAIMKRVNHKVPHVALQALTLLGACVANCGKIFHLEVCSRDFATEVRAVIKNKAHPKVCEKLKSLMVEWSEEFQKDPQFSLISATIKSMKEEGITFPPAGSQTVSAAAKNGTSSNKNKEDEDIAKAIELSLQEQKQQHTETKSLYPSSEIQLNNKVARKVRALYDFEAVEDNELTFKHGEIIIVLDDR

SEQ ID NO: 831978 - protein, 521 aa, Homo sapiens
MAENPSLENHRIKSFKNKGRDVETMRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGTSAQTQAVVQSNAVPLFLRLLRSPHQNVCEQAVWALGNIIGDGPQCRDYVISLGVVKPLLSFISPSIPITFLRNVTWVIVNLCRNKDPPPPMETVQEILPALCVLIYHTDINILVDTVWALSYLTDGGNEQIQMVIDSGVVPFLVPLLSHQEVKVQTAALRAVGNIVTGTDEQTQVVLNCDVLSHFPNLLSHPKEKINKEAVWFLSNITAGNQQQVQAVIDAGLIPMIIHQLAKGDFGTQKEAAWAISNLTISGRKDQVEYLVQQNVIPPFCNLLSVKDSQVVQVVLDGLKNILIMAGDEASTIAEIIEECGGLEKIEVLQQHENEDIYKLAFEIIDQYFSGDDIDEDPCLIPEATQGGTYNFDPTANLQTKEFNF

SEQ ID NO: 831979 - protein, 521 aa, Homo sapiens; identical to SEQ ID NO: 831978

SEQ ID NO: 831980 - protein, 521 aa, Homo sapiens; identical to SEQ ID NO: 831978

SEQ ID NO: 831981 - protein, 519 aa, Homo sapiens
MAENPSLENHRIKSFKNKGRDVETMRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGTSAQTQAVVQSNAVPLFLRLLRSPHQNVCEQAVWALGNIIGDGPQCRDYVISLGVVKPLLSFISPSIPITFLRNVTWVIVNLCRNKDPPPPMETVQEILPALCVLIYHTDINILVDTVWALSYLTDGGNEQIQMVIDSGVVPFLVPLLSHQEVKVQTAALRAVGNIVTGTDEQTQVVLNCDVLSHFPNLLSHPKEKINKEAVWFLSNITAGNQQQVQAVIDAGLIPMIIHQLAKGDFGTQKEAAWAISNLTISGRKDQVEYLVQQNVIPPFCNLLSVKDSQVVQVVLDGLKNILIMAGDEASTIAEIIEECGGLEKIEVLQQHENEDIYKLAFEIIDQYFSGDDIDEDPCLIPEATQGVPQADNCSLQFRINIP

SEQ ID NO: 831982 - protein, 521 aa, Homo sapiens; identical to SEQ ID NO: 831978

SEQ ID NO: 831983 - protein, 521 aa, Homo sapiens; identical to SEQ ID NO: 831978

SEQ ID NO: 831984 - protein, 132 aa, Homo sapiens
MRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGKWREPGRRSLQ

SEQ ID NO: 831985 - protein, 497 aa, Homo sapiens
MRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGTSAQTQAVVQSNAVPLFLRLLRSPHQNVCEQAVWALGNIIGDGPQCRDYVISLGVVKPLLSFISPSIPITFLRNVTWVIVNLCRNKDPPPPMETVQEILPALCVLIYHTDINILVDTVWALSYLTDGGNEQIQMVIDSGVVPFLVPLLSHQEVKVQTAALRAVGNIVTGTDEQTQVVLNCDVLSHFPNLLSHPKEKINKEAVWFLSNITAGNQQQVQAVIDAGLIPMIIHQLAKGDFGTQKEAAWAISNLTISGRKDQVEYLVQQNVIPPFCNLLSVKDSQVVQVVLDGLKNILIMAGDEASTIAEIIEECGGLEKIEVLQQHENEDIYKLAFEIIDQYFSGDDIDEDPCLIPEATQGGTYNFDPTANLQTKEFNF

SEQ ID NO: 831986 - protein, 281 aa, Homo sapiens
VSTRMFISVWYMRTHINILVDTVWALSYLTDGGNEQIQMVIDSGVVPFLVPLLSHQEVKVQTAALRAVGNIVTGTDEQTQVVLNCDVLSHFPNLLSHPKEKINKEAVWFLSNITAGNQQQVQAVIDAGLIPMIIHQLAKGDFGTQKEAAWAISNLTISGRKDQVEYLVQQNVIPPFCNLLSVKDSQVVQVVLDGLKNILIMAGDEASTIAEIIEECGGLEKIEVLQQHENEDIYKLAFEIIDQYFSGDDIDEDPCLIPEATQGGTYNFDPTANLQTKEFNF

SEQ ID NO: 831987 - protein, 265 aa, Homo sapiens
MAENPSLENHRIKSFKNKGRDVETMRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGTSAQTQAVVQSNAVPLFLRLLRSPHQNVCEQAVWALGNIIGDGPQCRDYVISLGVVKPLLSFISPSIPITFLRNVTWVIVNLCRNKDPPPPMETVQEILALWGPHFPFILTIFGDHWGLL

SEQ ID NO: 831988 - protein, 241 aa, Homo sapiens
RIGRRCAAQSGSKMAAQQRDCGGAAQLAGPAAEADPLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVVCPICASMPWGDPNYRSANFREHIQRRHRFSYDTFVDYDVDEEDMMNQVLQRSIIDQ

SEQ ID NO: 831989 - protein, 241 aa, Homo sapiens; identical to SEQ ID NO: 831988

SEQ ID NO: 831990 - protein, 111 aa, Homo sapiens
MEGVKATIKDASLQPRNVPNRYTFPCPYCPEKNFDQEGLVEHCKLFHSTDTKSVVCPICASMPWGDPNYRSANFREHIQRRHRFSYDTFVDYDVDEEDMMNQVLQRSIIDQ

SEQ ID NO: 831991 - protein, 264 aa, Homo sapiens
MHPPPLGFKRFSCLSPLSNWNYRHVLPRLDNFCIFSRAAQQRDCGGAAQLAGPAAEADPLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVVCPICASMPWGDPNYRSANFREHIQRRHRFSYDTFVDYDVDEEDMMNQVLQRSIIDQ

SEQ ID NO: 831992 - protein, 241 aa, Homo sapiens; identical to SEQ ID NO: 831988

SEQ ID NO: 831993 - protein, 111 aa, Homo sapiens; identical to SEQ ID NO: 831990

SEQ ID NO: 831994 - protein, 241 aa, Homo sapiens; identical to SEQ ID NO: 831988

SEQ ID NO: 831995 - protein, 166 aa, Homo sapiens
MHPPPLGFKRFSCLSPLSNWNYRHVLPRLDNFCIFSRAAQQRDCGGAAQLAGPAAEADPLGRFTCPVCLEVYEKPVQVPCGHVFCSACLQECLKPKKPVCGVCRSALAPGVRAVELERQIESTETSCHGCRKNCLPLLLTLFVTRSSSYWFSATSWSFCRLLWKII

SEQ ID NO: 831996 - protein, 66 aa, Homo sapiens
KVSPQQWTCMPGPPPPCPRERRPGTPAQTPGPLEKNSFFISISREDPKVKVSLFTVISGRSSLRPS

SEQ ID NO: 831997 - protein, 223 aa, Homo sapiens
SNRNRSYENRCPLLAAASLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVVCPICASMPWGDPNYRSANFREHIQRRHRFSYDTFVDYDVDEEDMMNQVLQRSIIDQ

SEQ ID NO: 831998 - protein, 832 aa, Homo sapiens [sequence omitted]

SEQ ID NO: 831999 - protein, 670 aa, Homo sapiens
MFEASEDVAIGTKVGNVTAKDPEGLDISYSLRGDTRGWLKIDHVTGEIFSVAPLDREARNSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTDFEEREYVVLIRINDGGRPPLEGIVSLPVTFCSCVEGSCFRPAGHQTGIPTVGMAVGILLTTLLVIGIILAVVFIRIKKDKGKDNVESAQASEVKPLRS

SEQ ID NO: 832000 - protein, 430 aa, Homo sapiens
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIEVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKPLYFTPKLEAQDNSALEHNSWKQLLFQNQRLFNYDSTPGIGMG

SEQ ID NO: 832001 - protein, 674 aa, Homo sapiens
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIEVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDCGQF

SEQ ID NO: 832002 - protein, 493 aa, Homo sapiens
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIEVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGKLNCPHPIKITQVRWNDPGAQYSLVDKEKLPRFPFSID

SEQ ID NO: 832003 - protein, 492 aa, Homo sapiens
MATPARAPESPPSADPALVAGPAEEAECPPPRQPQPAQNVLAAPRLRAPSSRGLGAAEFGGAAGNVEAPGETFAQRVSWGPAESPPGSFSSSSLGAPLPSRTLFPSLEGDFDSVTFASVLRASGRRACCGRAVPLPGQARMPARIARIERLPGVAGSYVAPGKFICKLPDKGKKIFDSFAKLKAAIAECEEVRRKSELFNPVSLDCKLRQKAIAEVDVGTDKAQNSDPILDTSSLVPGCSSVDNIKSSQTSQNQGLGRPTLEGDEETSEVEYTVNKGPASSNRDRVPPSSEASEHHPRHRVSSQAEDTSSSFDNLFIDRLQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 832004 - protein, 368 aa, Homo sapiens
MCSLPRGFEPQAPEDLAQRSLVELREMLKRQERLLRNEKFICKLPDKGKKIFDSFAKLKAAIAECEEVRRKSELFNPVSLDCKLRQKAIAEVDVGTDKAQNSDPILDTSSLVPGCSSVDNIKSSQTSQNQGLGRPTLEGDEETSEVEYTVNKGPASSNRDRVPPSSEASEHHPRHRVSSQAEDTSSSFDNLFIDRLQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 832005 - protein, 211 aa, Homo sapiens
MCSLPRGFEPQAPEDLAQRSLVELREMLKRQERLLRNELQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 832006 - protein, 368 aa, Homo sapiens; identical to SEQ ID NO: 832004

SEQ ID NO: 832007 - protein, 468 aa, Homo sapiens
MATPARAPESPPSADPALVAGPAEEAECPPPRQPQPAQNVLAAPRLRAPSSRGLGAAEFGGAAGNVEAPGETFAQRVSWGPAESPPGSFSSSSLGAPLPSRTLFPSLEGDFDSVTFASVLGRVDGGLAAAEPCLFLARKFICKLPDKGKKIFDSFAKLKAAIAECEEVRRKSELFNPVSLDCKLRQKAIAEVDVGTDKAQNSDPILDTSSLVPGCSSVDNIKSSQTSQNQGLGRPTLEGDEETSEVEYTVNKGPASSNRDRVPPSSEASEHHPRHRVSSQAEDTSSSFDNLFIDRLQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 832008 - protein, 368 aa, Homo sapiens; identical to SEQ ID NO: 832004

SEQ ID NO: 832009 - protein, 368 aa, Homo sapiens; identical to SEQ ID NO: 832004

SEQ ID NO: 832010 - protein, 368 aa, Homo sapiens; identical to SEQ ID NO: 832004

SEQ ID NO: 832011 - protein, 231 aa, Homo sapiens
MEALLSTPINPNNFPAKLWRLVNSPRYRSIRWDGRGEGLLIDQPLFEAELLSPPGPGGGGGTAGAGAEPELFKTTSFTSFIRQLNLYGFRKVVLGGPGGGKPAGNGPLHHFHNPHFRRDQPQLLVHLKRLTSANKAKLAAGLEVPCRPTKRFQRLLITSASAATAPLQHQQPPPPAGPRPEPHGPVAVGQFHRSFRRDSLSPYSCVSTPSHDHSTYPLKGLDRTPVPHRIW

SEQ ID NO: 832012 - protein, 122 aa, Homo sapiens
SRYLLMQVSHKRKYLLLCMRCQSILNMAMFRCKKDIAIKYSRTLNKHFESSSKVAQAPSPCIARSTGTPSPLSPMPSPASSVGSQSSAGSVGSSGVAATISTPVTIQNMTSSYVTITSHVLT

SEQ ID NO: 832013 - protein, 510 aa, Homo sapiens
MTKGRPRAAASNEPKPAVPPSSEKKKHKSSLPAPSKALSGPEPAKGNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIARSTGTPSPLSPMPSPASSVGSQSSAGSVGSSGVAATISTPVTIQNMTSSYVTITSHVLT

SEQ ID NO: 832014 - protein, 135 aa, Homo sapiens
GCGPGSGKGVVGRRFIRSRRTGARGQLPTGGRPVRMTGLLQKSDTRGTERPRYGGFHRQGRSRAEVLLTSQTGRRGRGAPHISDDGRQGRDSPHFLDVMAAGKRLMCGFFSPLFIHSCIHLFNDILLRNLLKPGC

SEQ ID NO: 832015 - protein, 89 aa, Homo sapiens
GCGPGSGKGVVGRRFIRSRRTGARGQLPTGGRPVRMTGLLQKSDTRGTERPRYGGFHRLMCGFFSPLFIHSCIHLFNDILLRNLLKPGC

SEQ ID NO: 832016 - protein, 84 aa, Homo sapiens
GCGPGSGKGVVGRRFIRSRRTGARGQLPTGGRPVRMTGLLQKSDTRGTERPRYGGFHRLMCGFFSPLFIHSCIHLFNDILLRNI

SEQ ID NO: 832017 - protein, 89 aa, Homo sapiens; identical to SEQ ID NO: 832015

SEQ ID NO: 832018 - protein, 89 aa, Homo sapiens; identical to SEQ ID NO: 832015

SEQ ID NO: 832019 - protein, 133 aa, Homo sapiens
MWLALQATATAPWVTGPSVPPSPSHAAGASAVTVPKHCCPLLLVPEPSGAWSAYHMGWYPGLRLALPWPAGFYSLRTGVGRWGWPQCPPGQPARYLVVMEYGVCIHILPWRYVEPQFPHEVHLVGERHGGPWA

SEQ ID NO: 832020 - protein, 56 aa, Homo sapiens
MDRKGSEREHLIGDAVITTGIVKNMDTKYWWVSGMAGTHIHGRWELHPLEIISQFV

SEQ ID NO: 832021 - protein, 67 aa, Homo sapiens
ALLTAAARGSIADPEAVAVVRGGAVAGALAQPTQGLLRVREAGRSGGLGGPGVGKSVDPAGQWGGET

SEQ ID NO: 832022 - protein, 443 aa, Homo sapiens
AGDVPWGTPGHGWHCFGGSAAWQIQGGIVDSRHQRRRRWVAGQRETLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 832023 - protein, 417 aa, Homo sapiens
RLWGFILLWYSCQRHTSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 832024 - protein, 257 aa, Homo sapiens
MTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 832025 - protein, 417 aa, Homo sapiens; identical to SEQ ID NO: 832023

SEQ ID NO: 832026 - protein, 417 aa, Homo sapiens; identical to SEQ ID NO: 832023

SEQ ID NO: 832027 - protein, 446 aa, Homo sapiens
RLWGFILLWYSCQRHTSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVQGDSHHLNPGRCLSCGQRHRGRAQLEWRRTWQGH

SEQ ID NO: 832028 - protein, 167 aa, Homo sapiens
LLLLIRGARLAISFSKSRATQQASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 832029 - protein, 232 aa, Homo sapiens
RLWGFILLWYSCQRHTSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEAGSASKVRTGSPRIPSRLLCYQS

SEQ ID NO: 832030 - protein, 232 aa, Homo sapiens; identical to SEQ ID NO: 832029

SEQ ID NO: 832031 - protein, 144 aa, Homo sapiens
ITLPLAERFRWKRVSGQRKALIAWVDNLPIWQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 832032 - protein, 137 aa, Homo sapiens
RLWGFILLWYSCQRHTSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKVSVDFPLMSLL

SEQ ID NO: 832033 - protein, 220 aa, Homo sapiens
RLWGFILLWYSCQRHTSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRSYGQTLGQGRQPPSPSSQEAPLNPKAQSKGGQHSNGTQNHCSETFNVPDQWVTISPFKADALHFLIAFWASTTGHTSMGDYYQ

SEQ ID NO: 832034 - protein, 186 aa, Homo sapiens
RLWGFILLWYSCQRHTSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKQEVLLKSEQVLQGSPRDYSVTSHETLKPTSLIYSQNRSPQHPLETTLSPLMKHYNLQALH

SEQ ID NO: 832035 - protein, 417 aa, Homo sapiens; identical to SEQ ID NO: 832023

SEQ ID NO: 832036 - protein, 381 aa, Homo sapiens
MRSRCMCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 832037 - protein, 382 aa, Homo sapiens
MDSIVLVCESRGRDCSRAEATSRIDCPRTVIDLPLSLLWTLPLARSRCDDARTAREKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 832038 - protein, 320 aa, Homo sapiens
RLWGFILLWYSCQRHTSPQSLGEEPLIPSIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 832039 - protein, 417 aa, Homo sapiens; identical to SEQ ID NO: 832023

SEQ ID NO: 832040 - protein, 378 aa, Homo sapiens
RLWGFILLWYSCQRHTSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTNWDDMEKIWHHSFYNELRVDLKSTPPCSQRLP

SEQ ID NO: 832041 - protein, 107 aa, Homo sapiens
MESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 832042 - protein, 211 aa, Homo sapiens
RLWGFILLWYSCQRHTSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDFSDGVTHNGTWIGYR

SEQ ID NO: 832043 - protein, 187 aa, Homo sapiens
RLWGFILLWYSCQRHTSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKPHDHFSNLGCQHLSLDYCNGFLADFLVSCPHPTRINSLHCCKTDLSKHRSAHVTHLLRNLQ

SEQ ID NO: 832044 - protein, 178 aa, Homo sapiens
RGSVVLWDGVAGRLPGSSASSAAFVAPWGLSGSAAHCPHRGAWLGGGAEWSLSSCDFPDASPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPGSASKVRTGSPRIPSRLLCYQS

SEQ ID NO: 832045 - protein, 77 aa, Homo sapiens
RSSFFRQLPSSSFLRHRGVFLTPLLAMSSHKTFRIKRFLAKKQKQNRPIPQWIRMKTGNKIRYNSKRRHWRRTKLGL

SEQ ID NO: 832046 - protein, 74 aa, Homo sapiens
GSEFGSNVGSSRHRGVFLTPLLAMSSHKTFRIKRFLAKKQKQNRPIPQWIRMKTGNKIRYNSKRRHWRRTKLGL

SEQ ID NO: 832047 - protein, 77 aa, Homo sapiens; identical to SEQ ID NO: 832045

SEQ ID NO: 832048 - protein, 70 aa, Homo sapiens
RPPTTTKFAAASTLTPLLAMSSHKTFRIKRFLAKKQKQNRPIPQWIRMKTGNKIRYNSKRRHWRRTKLGL

SEQ ID NO: 832049 - protein, 97 aa, Homo sapiens
GDHDSPHNPGDHAWGVGLFPFFPVAASTITSSFLRHRGVFLTPLLAMSSHKTFRIKRFLAKKQKQNRPIPQWIRMKTGNKIRYNSKRRHWRRTKLGL

SEQ ID NO: 832050 - protein, 88 aa, Homo sapiens
GGRLLLLNSRPRRREKTTEGASSFLRHRGVFLTPLLAMSSHKTFRIKRFLAKKQKQNRPIPQWIRMKTGNKIRYNSKRRHWRRTKLGL

SEQ ID NO: 832051 - protein, 88 aa, Homo sapiens; identical to SEQ ID NO: 832050

SEQ ID NO: 832052 - protein, 88 aa, Homo sapiens; identical to SEQ ID NO: 832050

SEQ ID NO: 832053 - protein, 67 aa, Homo sapiens
GRVGPDPRVRLTPLLAMSSHKTFRIKRFLAKKQKQNRPIPQWIRMKTGNKIRYNSKRRHWRRTKLGL

SEQ ID NO: 832054 - protein, 88 aa, Homo sapiens; identical to SEQ ID NO: 832050

SEQ ID NO: 832055 - protein, 88 aa, Homo sapiens; identical to SEQ ID NO: 832050

SEQ ID NO: 832056 - protein, 122 aa, Homo sapiens
HPSQKASSSREVSKKQEAEGPGIQKSRVKSVRQPRRRTTRAHCRRPQSSPPEPLPSSFLRHRGVFLTPLLAMSSHKTFRIKRFLAKKQKQNRPIPQWIRMKTGNKIRYNSKRRHWRRTKLGL

SEQ ID NO: 832057 - protein, 122 aa, Homo sapiens; identical to SEQ ID NO: 832056

SEQ ID NO: 832058 - protein, 70 aa, Homo sapiens; identical to SEQ ID NO: 832048

SEQ ID NO: 832059 - protein, 89 aa, Homo sapiens
IDPWHPRAIALIPANSAIMAGASSFLRHRGVFLTPLLAMSSHKTFRIKRFLAKKQKQNRPIPQWIRMKTGNKIRYNSKRRHWRRTKLGL

SEQ ID NO: 832060 - protein, 122 aa, Homo sapiens; identical to SEQ ID NO: 832056

SEQ ID NO: 832061 - protein, 74 aa, Homo sapiens
RPPTTTKFAAASTRGVFLTPLLAMSSHKTFRIKRFLAKKQKQNRPIPQWIRMKTGNKIRYNSKRRHWRRTKLGL

SEQ ID NO: 832062 - protein, 67 aa, Homo sapiens; identical to SEQ ID NO: 832053

SEQ ID NO: 832063 - protein, 74 aa, Homo sapiens; identical to SEQ ID NO: 832046

SEQ ID NO: 832064 - protein, 88 aa, Homo sapiens; identical to SEQ ID NO: 832050

SEQ ID NO: 832065 - protein, 122 aa, Homo sapiens; identical to SEQ ID NO: 832056

SEQ ID NO: 832066 - protein, 98 aa, Homo sapiens
PGRCRVGQGFRFPFACSELVLEAGGGRWQPPPKSWPDCGLPVACATWRSSHKTFRIKRFLAKKQKQNRPIPQWIRMKTGNKIRYNSKRRHWRRTKLGL

SEQ ID NO: 832067 - protein, 88 aa, Homo sapiens; identical to SEQ ID NO: 832050

SEQ ID NO: 832068 - protein, 88 aa, Homo sapiens; identical to SEQ ID NO: 832050

SEQ ID NO: 832069 - protein, 70 aa, Homo sapiens; identical to SEQ ID NO: 832048

SEQ ID NO: 832070 - protein, 108 aa, Homo sapiens
HPSQKASSSREVSKKQEAEGPGIQKSRVKSVRQPRRRTTRAHCRRPQSSPPEPLPSSFLRHRGVFLTPLLAMSSHKTFRIKRFLAKKQKQNRPIPQWIRMKTGNKISS

SEQ ID NO: 832071 - protein, 238 aa, Homo sapiens; identical to SEQ ID NO: 768096

SEQ ID NO: 832072 - protein, 238 aa, Homo sapiens; identical to SEQ ID NO: 768096

SEQ ID NO: 832073 - protein, 103 aa, Homo sapiens
TACSAWALPRGSGEEAVAVSGPGPVGVLLPSWLTPTPGTLAPRSRTTSTMAAAWPPPPCTSEWVRCPLSSASQPLVCTARPLEADFRLPRESGHLLGLTGSAH

SEQ ID NO: 832074 - protein, 194 aa, Homo sapiens
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKVSYVIMVNLKYNSGCVNINNLKKL

SEQ ID NO: 832075 - protein, 238 aa, Homo sapiens; identical to SEQ ID NO: 768096

SEQ ID NO: 832076 - protein, 113 aa, Homo sapiens
MADPDPRYPRSSIEDDFNYGSSVASATVHIRMGTLSPLQCLPAACLHCSASRSRLPASEGERPSPGTHRECSLSSRPSFSGYQAQKACGCPVCAPAPQRAPRCRKGQMETAAA

SEQ ID NO: 832077 - protein, 256 aa, Homo sapiens
TACSAWALPRGSGEEAVAVSGPGPVGVLLPSWLTPTPGTLAPRSRTTSTMAAAWPPPPCTSEWVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 832078 - protein, 118 aa, Homo sapiens
MQGRGLSLSRFSWVGDERTSIGFLFRPSPHSPATFVFCSVSVASWPPFLSSRDLSAHSWDRAALSSTGEMKRGLPFRKVWSLASVPGTQPCKARSSSPRGFPGDVTGLPPREGATPRP

SEQ ID NO: 832079 - protein, 168 aa, Homo sapiens
PGFGYGGRASDYKSAHKGFKGVDAQGHRDTGILDSIGRFFGGDRGAPKRGSGKDSHHPARTAHYGSLPQKSHGRTQDENPVVHFFKNIVTPRTPPPSQGKGAEEPGDQDLATEAERPTINRLTRDSRESMPRARFPKFLSWEEEIVALDHPWLDAENPPGSGILSSAS

SEQ ID NO: 832080 - protein, 179 aa, Homo sapiens
PGFGYGGRASDYKSAHKGFKGVDAQGHRDTGILDSIGRFFGGDRGAPKRGSGKDSHHPARTAHYGSLPQKSHGRTQDENPVVHFFKNIVTPRTPPPSQGKGRGLSLSRFSWGAEEPGDQDLATEAERPTINRLTRDSRESMPRARFPKFLSWEEEIVALDHPWLDAENPPGSGILSSAS

SEQ ID NO: 832081 - protein, 179 aa, Homo sapiens; identical to SEQ ID NO: 832080

SEQ ID NO: 832082 - protein, 179 aa, Homo sapiens; identical to SEQ ID NO: 832080

SEQ ID NO: 832083 - protein, 179 aa, Homo sapiens; identical to SEQ ID NO: 832080

SEQ ID NO: 832084 - protein, 179 aa, Homo sapiens; identical to SEQ ID NO: 832080

SEQ ID NO: 832085 - protein, 179 aa, Homo sapiens; identical to SEQ ID NO: 832080

SEQ ID NO: 832086 - protein, 179 aa, Homo sapiens; identical to SEQ ID NO: 832080

SEQ ID NO: 832087 - protein, 179 aa, Homo sapiens; identical to SEQ ID NO: 832080

SEQ ID NO: 832088 - protein, 179 aa, Homo sapiens; identical to SEQ ID NO: 832080

SEQ ID NO: 832089 - protein, 179 aa, Homo sapiens; identical to SEQ ID NO: 832080

SEQ ID NO: 832090 - protein, 179 aa, Homo sapiens; identical to SEQ ID NO: 832080

SEQ ID NO: 832091 - protein, 179 aa, Homo sapiens; identical to SEQ ID NO: 832080

SEQ ID NO: 832092 - protein, 179 aa, Homo sapiens; identical to SEQ ID NO: 832080

SEQ ID NO: 832093 - protein, 179 aa, Homo sapiens; identical to SEQ ID NO: 832080

SEQ ID NO: 832094 - protein, 179 aa, Homo sapiens; identical to SEQ ID NO: 832080

SEQ ID NO: 832095 - protein, 179 aa, Homo sapiens; identical to SEQ ID NO: 832080

SEQ ID NO: 832096 - protein, 114 aa, Homo sapiens
MSVYESKLYYLVIPLICIQSLRSFFIQKQMWIKMYYKKKKLCYGVQSLGVVSAVDVSGEPVAAGSSKRWSLSAIQIADAVFYVMFRVFGGCVILERKKFFPKKSLVYWVFSHNL

SEQ ID NO: 832097 - protein, 179 aa, Homo sapiens; identical to SEQ ID NO: 832080

SEQ ID NO: 832098 - protein, 179 aa, Homo sapiens; identical to SEQ ID NO: 832080

SEQ ID NO: 832099 - protein, 84 aa, Homo sapiens
MALNDHFVKLISWYDNEFGYSNRVVDLMAHMASKEEDPWTTSPSKSTRGRERPSLLGSPCHTQSPTTLNLPSSQLPCRPLEEGR

SEQ ID NO: 832100 - protein, 216 aa, Homo sapiens
PGFGYGGRASDYKSAHKGFKGVDAQGHRDTGILDSIGRFFGGDRGAPKRGSGKDSHHPARTAHYGSLPQKSHGRTQDENPVVHFFKNIVTPRTPPPSQGKGRGLSLSRFSWVGDERTSIGFLFRPSPHSPATFVFCSVSVASWPPFLSSRDLSAHSWDRAALSSTGEMKRGLPFRKVWSLASVPGTQPCKARSSSPRGFPGDVTGLPPREGATPRP

SEQ ID NO: 832101 - protein, 72 aa, Homo sapiens
TPFSVVAAPWLLNHSPVQSGAWALPRGPGGSSQWLKQRAQHRGWRLSSVVFSCRGPKSQETRIWLRRQSVRL

SEQ ID NO: 832102 - protein, 179 aa, Homo sapiens; identical to SEQ ID NO: 832080

SEQ ID NO: 832103 - protein, 82 aa, Homo sapiens
PGFGYGGRASDYKSAHKGFKGVDAQGHRDTGILDSIGRFFGGDRGAPKRGSGKDSHHPARTAHYGSLPQKSHGRTQDENVRL

SEQ ID NO: 832104 - protein, 120 aa, Homo sapiens
PGFGYGGRASDYKSAHKGFKGVDAQGHRDTGILDSIGRFFGGDRGAPKRGSGKDSHHPARTAHYGSLPQKSHGRTQDENPVVHFFKNIRADDPSPNACGVVHVVGVRPRQPTGNFRPTVK

SEQ ID NO: 832105 - protein, 179 aa, Homo sapiens; identical to SEQ ID NO: 832080

SEQ ID NO: 832106 - protein, 179 aa, Homo sapiens; identical to SEQ ID NO: 832080

SEQ ID NO: 832107 - protein, 179 aa, Homo sapiens; identical to SEQ ID NO: 832080

SEQ ID NO: 832108 - protein, 179 aa, Homo sapiens; identical to SEQ ID NO: 832080

SEQ ID NO: 832109 - protein, 179 aa, Homo sapiens; identical to SEQ ID NO: 832080

SEQ ID NO: 832110 - protein, 114 aa, Homo sapiens; identical to SEQ ID NO: 832096

SEQ ID NO: 832111 - protein, 179 aa, Homo sapiens; identical to SEQ ID NO: 832080

SEQ ID NO: 832112 - protein, 179 aa, Homo sapiens; identical to SEQ ID NO: 832080

SEQ ID NO: 832113 - protein, 179 aa, Homo sapiens; identical to SEQ ID NO: 832080

SEQ ID NO: 832114 - protein, 75 aa, Homo sapiens
PGFGYGGRASDYKSAHKGFKGVDAQGHRDTGILDSIGRFFGGDRGAPKRGSGKKVSSEEERSFSLNGKSKGEISR

SEQ ID NO: 832115 - protein, 33 aa, Homo sapiens
MGRGSNCEGEEGCWPLLSSTQDVRTLGGGTGVI

SEQ ID NO: 832116 - protein, 198 aa, Homo sapiens
IRWEGTSGTLDRMLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKVGASSDPCGQLRPTLLLTSLHHFMHSRNLYILGNFMQLKCFSSQKLKCLSMFPHYICTLKQPHLLLEKYSYYLISG

SEQ ID NO: 832117 - protein, 467 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 832118 - protein, 358 aa, Homo sapiens
MKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 832119 - protein, 479 aa, Homo sapiens
IRWEGTSGTLDRMLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 832120 - protein, 812 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPREQGTWERCDPGKYSVSLPWSAKEYRQRSLLEKELLFFAYDVFGIPFVDPDSWTPEEVIPKRLQEKQKEDLEETAWLDQSDEALEASCSPGRCELLARGGQVQFGKSGWSPGLALECSPQSGCAHRSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832121 - protein, 804 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERVRAARAGESSWCCGDPFPERPWFAFLFPKSHCQWLRHERSTWDTSSNALSLWSHCLVLPGPAVNGIQVGKEVKTGSDAEFLVPSLGPTSAVLFQRVGPAGKEMSLGPLRNLPCPLGSSS

SEQ ID NO: 832122 - protein, 411 aa, Homo sapiens
DAWVDPRVREVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832123 - protein, 219 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMVKKTLSPSFFLSF

SEQ ID NO: 832124 - protein, 706 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPREDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832125 - protein, 701 aa, Homo sapiens
AGLGIRTSAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832126 - protein, 720 aa, Homo sapiens
PGGGPSPGVGLRPWWRVAGGSVRSEGAMAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832127 - protein, 804 aa, Homo sapiens; identical to SEQ ID NO: 832121

SEQ ID NO: 832128 - protein, 736 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832129 - protein, 736 aa, Homo sapiens; identical to SEQ ID NO: 832128

SEQ ID NO: 832130 - protein, 722 aa, Homo sapiens
PGGGPSPGVGLRPWWRVAGGSVRSEGAMAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTREQPLDAQQGPPEPAQESLSGSESKPKDEL

SEQ ID NO: 832131 - protein, 559 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLAGSG

SEQ ID NO: 832132 - protein, 503 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDPGSHLLRLLPLVSLQLVHLVSST

SEQ ID NO: 832133 - protein, 206 aa, Homo sapiens
DTPLVHWAFRRLKHILGSTSPAKKKSYAVSRGAPLLTCVTLAPEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832134 - protein, 736 aa, Homo sapiens; identical to SEQ ID NO: 832128

SEQ ID NO: 832135 - protein, 270 aa, Homo sapiens [sequence omitted]

SEQ ID NO: 832136 - protein, 736 aa, Homo sapiens; identical to SEQ ID NO: 832128

SEQ ID NO: 832137 - protein, 794 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKLRTLKKLHGWISLMKHLRLLSPGRCELLARGGQVQFGKSGWSPGLALECSPQSGCAHRSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832138 - protein, 742 aa, Homo sapiens
MLGVRSSLRRGTRVTVTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832139 - protein, 697 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERVRAARAGQGAGR

SEQ ID NO: 832140 - protein, 769 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKFHVAGEASQSWWKAKRSKSILHGWQQAKRELLQLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832141 - protein, 801 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKRGVVLVRFHTADKDVPETGQFTKERGLLGLTVPCGWGSLTIMVEGKEEQVTSYMDEQQAKRELLQLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832142 - protein, 697 aa, Homo sapiens; identical to SEQ ID NO: 832139

SEQ ID NO: 832143 - protein, 641 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDDRSPRMSYDSVQVRRMGD

SEQ ID NO: 832144 - protein, 296 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKAL

SEQ ID NO: 832145 - protein, 296 aa, Homo sapiens; identical to SEQ ID NO: 832144

SEQ ID NO: 832146 - protein, 188 aa, Homo sapiens
GFAKPRKYAQLVVYSTLDVPHMPGEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 832147 - protein, 234 aa, Homo sapiens
DAWVDPRVREVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLAGSG

SEQ ID NO: 832148 - protein, 348 aa, Homo sapiens [sequence omitted]

SEQ ID NO: 832149 - protein, 177 aa, Homo sapiens
MNGTEGPNFYVPFSNATGVVRSPFEYPQYYLAEPWQFSMLAAYMFLLIVLGFPINFLTLYVTVQHKKLRTPLNYILLNLAVADLFMVLGGFTSTLYTSLHGYFVFGPTGCNLEGFFATLGGEIALWSLVVLAIERYVVVCKPMSNFRFGENHAIMGVAFTWVMALACAAPPLAGWSR

SEQ ID NO: 832150 - protein, 145 aa, Homo sapiens
NRAILDPPLTGRFSTIGSHEFLHVSSPQGAAAQQQESATTQKAEKEVTRMVIIMVIAFLICWVPYASVAFYIFTHQGSNFGPIFMTIPAFFAKSAAIYNPVIYIMMNKQFRNCMLTTICCGKNPLGDDEASATVSKTETSQVAPA

SEQ ID NO: 832151 - protein, 1007 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832152 - protein, 1067 aa, Homo sapiens [sequence omitted]

SEQ ID NO: 832153 - protein, 1100 aa, Homo sapiens
GCASGETQLRSLGNHAWQVHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832154 - protein, 1275 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGQGPSAEFPLPLPDCGLAPASPFQTCPHCKELHTFLFFWSQQQRRRNLSPQGLSKHSPELITQHEKSWNLSEMNLCMGVLLKWYFKKVPLFTLVLHCHATRWCRSPKCHPPPSFPLCSKSSGLLGLGQMVVCVIRTRGVLCVEHSPQPKLGSQLRGQAMLGCLGKVMHYQETYLLSPALVPPGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832155 - protein, 1105 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQGAGGSENVSVLLPLVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832156 - protein, 528 aa, Homo sapiens
MVTARGVWDRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832157 - protein, 965 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQVPQNSKRNYG

SEQ ID NO: 832158 - protein, 241 aa, Homo sapiens
MEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832159 - protein, 157 aa, Homo sapiens
QPPTTTKFPAGRQRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832160 - protein, 539 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGEQAFLPR

SEQ ID NO: 832161 - protein, 123 aa, Homo sapiens
KPPRAPFRWRGRGRQSEALSPEIPGRARPGAQGAGRGRGRSGRGEPGRGAPGCGRPPALPTAPWSRAHSQRKCFDHSASEIDPGLRSPVSRNILPPFVEAVWWREVEPTRTEAVSLSGGKHEC

SEQ ID NO: 832162 - protein, 1093 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832163 - protein, 130 aa, Homo sapiens
MEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMIT

SEQ ID NO: 832164 - protein, 1233 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATAKEKEPVPSGIKQAQPYLITQHEKSWNLSEMNLCMGVLLKWYFKKVPLFTLVLHCHATRWCRSPKCHPPPSFPLCSKSSGLLGLGQMVVCVIRTRGVLCVEHSPQPKLGSQLRGQAMLGCLGKVMHYQETYLLSPALVPPGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832165 - protein, 1186 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPKDEGVYVYWGMGRGRGSRQTSALLGVTECRLLLACKLCEGRMPVCLHFLFSQVSKTQPDTVCKWFSVNECQGSPLLRRGGLTPRPHSTWWLFQELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832166 - protein, 1122 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQDLQGLRHHHALCCLTGAGAGGSENVSVLLPLVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 832167 - protein, 405 aa, Homo sapiens [sequence omitted]

SEQ ID NO: 832168 - protein, 1170 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKEEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSMFPRETRQKRKHYGGWGPKVLGLTGLPAGDPKGTPNTNGPCCRPWDAKRRRPQLDPPGAQATISDILRRADHHGWAHALGPPGKANGRAHMLKPGGQEKTLKRNRSGLEYGARALEGTQCSLWREKAGGNSWSNPQMRIALNPGFQRGSRRASRRWLGLGENRGARGLDEGLGRPWFSVPQQRK

SEQ ID NO: 832169 - protein, 757 aa, Homo sapiens
TGSGPSRLRSRRHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVKRGGPAQHFFFSLFFLPKP

SEQ ID NO: 832170 - protein, 129 aa, Homo sapiens
GVAGVPSSNPTPLPSWPTMNLTSLSRLQEVNSSLKVSDHFPQRSQHLWHILGLSRLLKPPPPAIVHLPPPLGFKVREMRGKLAIGITANFVNGRTVEETQVPEISGVARIYNQSFFQSLLKATGQGPSC

SEQ ID NO: 832171 - protein, 1118 aa, Homo sapiens
MALLKSAVYEVTGPSCGRGECIEEVGFGAFQEFLVDNRGTLTQTSKTFFSTSSFSHALPSSVSFCTQSRGGVYPCQCVSENVCSEKPVGSPRLLISSQNSVAQVLWSHPVHSLLLELFFQAISGKRFLPLALATSLLHTYHTSVLWRVSVRKSHTFLKMKQNVKGNVIRFGQSSPTDKKALGQAHTCNPKEHFGRLGREDCLSPGVQYLSGKHLISTKYKKVNWAWWSMPVVSATQEAEMRGSLEPEEVQATVSEITPLPSSLGDRVRPCSKKKKKPKKPQWLFAFEGGMKRTSTLRLYKTVKLVVGLTFIILGFGEAEAERLLEPEEFETGLGSIARPHLYIKKKMLKQEITETEHSHPVSSVTFSSRDGQLSEVRIISEVQQNKLFTINNSVENDVQMVKCGNVLDNSIFSLCFSLTILLGLTVEGHRCLNIERAVSHQFYCECEKVKAVADFGSRYTKIGMTQRRLAWPPARGRSADSCSIPYFFKKRLHCAPTWSKKEKHEVSCLLTIKINHSNNIIEHSTLKIINKTINETLEHTLKSTYTHESICVILCCLFYYPGFHTQMSISIRKSLKCLNCELIRRKMKYVSTLVTLFFTDIMISLQPYRTNEKLEAIPRTCDGVNPLLTVTHISAFEETQATWKLPMGGHNLNVPMSYRGEFNQNELKHGTITENLKRVYLAECVMPAIPALWEAKAGRSPEVRSLRPPGQHDETLVSIKNTKISQMWWHMPVIPVSREAEAGEYGTQEAEAAVNQDCATALQPGRRSETPISKNKKKNKLKIVDPGGHSKMFTIDDRETITVQNVEENSYDNHKICIRKTLQIYFAPCNFMNWQYFLKLGYSKRISLGNGNVKTRSNKKVVFLKGNATGLLFIGIDKARKEIKSQPNSIHCIYCILLIPSQQKSKSCLAKHIYSQRWANYICCQHDGIRNRNPPAVGKIARFIPSKCSSAPLPLHAHQTTAKSLVTEFLIQRFVSFCPYLKTKLFVCFEEKAKATKTPNHLKSNLNPIKKKSTSGTKQLSGLGCVVRHFCVCPTWSLVLWTIVTVKLWLNTVKDSKAPLCSQVQLRLHKYPTRMSQSSLLQLLSEQSARQHWLGFYFCSQLTLHQVYTVLAAFDFSS

SEQ ID NO: 832172 - protein, 889 aa, Homo sapiens
MPVVSATQEAEMRGSLEPEEVQATVSEITPLPSSLGDRVRPCSKKKKKPKKPQWLFAFEGGMKRTSTLRLYKTVKLVVGLTFIILGFGEAEAERLLEPEEFETGLGSIARPHLYIKKKMLKQEITETEHSHPVSSVTFSSRDGQLSEVRIISEVQQNKLFTINNSVENDVQMVKCGNVLDNSIFSLCFSLTILLGLTVEGHRCLNIERAVSHQFYCECEKVKAVADFGSRYTKIGMTQRRLAWPPARGRSADSCSIPYFFKKRLHCAPTWSKKEKHEVSCLLTIKINHSNNIIEHSTLKIINKTINETLEHTLKSTYTHESICVILCCLFYYPGFHTQMSISIRKSLKCLNCELIRRKMKYVSTLVTLFFTDIMISLQPYRTNEKLEAIPRTCDGVNPLLTVTHISAFEETQATWKLPMGGHNLNVPIHIEVNLIKMSYNMEQSLNNLKRVYLAECVMPAIPALWEAKAGRSPEVRSLRPPGQHDETLVSIKNTKISQMWWHMPVIPVSREAEAGEYGTQEAEAAVNQDCATALQPGRRSETPISKNKKKNKLKIVDPGGHSKMFTIDDRETITVQNVEENSYDNHKICIRKTLQIYFAPCNFMNWQYFLKLGYSKRISLGNGNVKTRSNKRLFFEGKCHRPAFIGIDKARKEIKSQPNSIHCIYCILLIPSQQKSKSCLAKHIYSQRWANYICCQHDGIRNRNPPAVGKIARFIPSKCSSAPLPLHAHQTTAKSLVTEFLIQRFVSFCPYLKTKLFVCFEEKAKATKTPNHLKSNLNPIKKNSTSGTKQLSGLGCVVRHFCVCPTWSLVLWTIVTVKLWLNTVKDSKAPLCSQVQLRLHKYPTRMSQSSLLQLLSEQSARQHWLGFYFCSQLTLHQVYTVLAAFDFSS

SEQ ID NO: 832173 - protein, 851 aa, Homo sapiens
MRPCSKKKKKPKKPQWLFAFEGGYEENVHFKALKDSEAGCRAHFYNPEDLGKLKQKDCLSLEFETGLGSIARPHLYIKKKMLKQEITETEHSHPVSSVTFSSRDGQLSEVRIISEVQQNKLFTINNSVENDVQMVKCGNVLDNSIFSLCFSLTILLGLTVEGHRCLNIERAVSHQFYCECEKVKAVADFGSRYTKIGMTQRRLAWPPARGRSADSCSIPYFFKKRLHCAPTWSYKEKHEVSCLLTIKINHSNNIIEHSTLKIINKTINETLEHTLKSTYTHESICVILCCLFYYPGFHTQMSISIRKSLKCLNCELIRRKMKYVSTLVTLFFTDIMISLQPYRTNEKLEAIPRTCDGVNPLLTVTHISAFEETQATWKLPMGGHNLNVPIHIEVNLIKMSYNMEQSLNNLKRVYLAECVMPAIPALWEAKAGRSPEVRSLRPPGQHDETLVSIKNTKISQMWWHMPVIPVSREAEAGEYGTQEAEAAVNQDCATALQPGRRSETPISKNKKKNKLKIVDPGGHSKMFTIDDRETITVQNVEENSYDNHKICIRKTLQIYFAPCNFMNWQYFLKLGYSKRISLGNGNVKTRSNKRLFFEGKCHRPAFIGIDKARKEIKSQPNSIHCIYCILLIPSQQKSKSCLAKHIYSQRWANYICCQHDGIRNRNPPAVGKIARFIPSKCSSAPLPLHAHQTTAKSLVTEFLIQRFVSFCPYLKTKLFVCFEEKAKATKTPNHLKSNLNPIKKKSTSGTKQLSGLGCVVRHFCVCPTWSLVLWTIVTVKLWLNTVKDSKAPLCSQVQLRLHKYPTRMSQSSLLQLLSEQSARQHWLGFYFCSQLTLHQVYTVLAAFDFSS

SEQ ID NO: 832174 - protein, 257 aa, Homo sapiens
MEAPGPAQAAAAESNSREVTEDAADWAPALCPSPEARSPEAPAYRLQDCDALVTMGTGTFGRVHLVKEKTAKHFFALKVMSIPDVIRRKQEQHVHNEKSVLKEVSHPFLIRLFWTWHEERFLYMLMEYVPGGELFSYLRNRGHFSSTTGLFYSAEIICAIEYLHSKEIVYRDLKPENILLDRDGHIKLTDFGFAKKLVDRQGLILSPKLKCRCTILSHYSLKLLGSSDPPSSASEVAGTTGMCHHTRLIFLFLILEM

SEQ ID NO: 832175 - protein, 1117 aa, Homo sapiens
MALLKSAVYEVTGPSCGRGECIEEVGFGAFQEFLVDNRGTLTQTSKTFFSTSSFSHALPSSVSFCTQSRGGVYPCQCVSENVCSEKPVGSPRLLISSQNSVAQVLWSHPVHSLLLELFFQAISGKRFLPLALATSLLHTYHTSVLWRVSVRKSHTFLKMKQNVKGNVIRFGQSSPTDKKALGQAHTCNPKEHFGRLGREDCLSPGVQYLSGKHLISTKYKKVNWAWWSMPVVSATQEAEMRGSLEPEEVQATVSEITPLPSSLGDRVRPCSKKKKKPKKPQWLFAFEGGMKRTSTLRLYKTVKLVVGLTFIILGFGEAEAERLLEPEEFETGLGSIARPHLYIKKKMLKQEITETEHSHPVSSVTFSSRDGQLSEVRIISEVQQNKLFTINNSVENDVQMVKCGNVLDNSIFSLCFSLTILLGLTVEGHRCLNIERAVSHQFYCECEKVKAVADFGSRYTKIGMTQRRLAWPPARGRSADSCSIPYFFKKRLHCAPTWSKKEKHEVSCLLTIKINHSNNIIEHSTLKIINKTINETLEHTLKSTYTHESICVILCCLFYYPGFHTQMSISIRKSLKCLNCELIRRKMKYVSTLVTLFFTDIMISLQPYRTNEKLEAIPRTCDGVNPLLTVTHISAFEETQATWKLPMGGHNLNVPMSYRGYFNQNELKHGTITENLKRVYLAECVMPAIPALWEAKAGRSPEVRSLRPPGQHDETLVSIKNTKISQMWWHMPVIPVSREAEAGEYGTQEAEAAVNQDCATALQPGRRSETPISKNKKKNEIKIVDPGGHSKMFTIDDRETITVQNVEENSYDNHKICIRKTLQIYFAPCNFMNWQYFLKLGYSKRISLGNGNVKTRSNKRLFFEGKCHRPAFIGIDKARKEIKSQPNSIHCIYRILLIPSQQKSKSCLAKHIYSQRWANYICCQHDGIRNRNPPAVGKIARFIPSKCSSAPLPLHAHQTTAKSLVTEFLIQRFVSFCPYLKTKLFVCFEEKAKATKTPNHLKSNLNPIKKKSTSGTKQLSGLGCVVRHFCVCPTWSLVLWTIVTVKLWLNTVKDSKAPLCSQVQLRLHKYPTRMSQSSLLQLLSEQSARQHWLGFYFCSQLTLHQVYTVLAAFDFSS

SEQ ID NO: 832176 - protein, 855 aa, Homo sapiens
MGDRVRPCSKKKKKPKKPQWLFAFEGGMKRTSTLRLYKTVKLVVGLTFIILGFGEAEAERLLEPEEFETGLGSIARPHLYIKKKMLKQEITETEHSHPVSSVTFSSRDGQLSEVRIISMVQQNKLFTINNSVENDVQMVKCGNVLDNSIFSLCFSLTILLGLTVEGHRCLNIERAVSHQFYCECEKVKAVADFGSRYTKIGMTQRRLAWPPARGRSADSCSIPYFFKKRLHCAPTWSKKEKHEVSCLLTIKINHSNNIIEHSTLKIINKTINETLEHTLKSTYTHESICVILCCLFYYPGFHTQMSISIRKSLKCLNCELIRRKMKYVSTLVTLFFTDIMISLQPYRTNEKLEAIPRTCDGVNPLLTVTHISAFEETQATWKLPMGGHNLNVPMSYRGYFNQNELKHGTITENLKRVYLAECVMPAIPALWEAKAGRSPEVRSLRPPGQHDETLVSIKNTKISQMWWHMPVIPVSREAEAGEYGTQEAEAAVNQDCATALQPGRRSETPISKNKKKNKLKIVDPGGHSKMFTIDDRETITVQNVEENSYDNHKICIRKTLQIYFAPCNFMNWQYFLKLGYSKRISLGNGNVKTRSNKRLFFEGKCHRPAFIGIDKARKEIKSQPNSIHCIYCILLIPSQQKSKSCLAKHIYSQRWANYICCQHDGIRNRNPPAVGKIARFIPSKCSSAPLPLHAHQTTAKSLVTEFLIQRFVSFCPYLKTKLFVCFEEKAKATKTPNHLKSNLNPIKKKSTSGTKQLSGLGCVVRHFCVCPTWSLVLWTIVTVKLWLNTVKDSKAPLCSQVQLRLHKYPTRMSQSSLLQLLSEQSARQHWLGFYFCSQLTLHQVYTVLAAFDFSS

SEQ ID NO: 832177 - protein, 41 aa, Homo sapiens
MVIFSQLFEDQILLSPGHCRRVEKSAATVNATVEDIILSSS

SEQ ID NO: 832178 - protein, 136 aa, Homo sapiens
GTVFSWEGGSPEPICSQNLVLERRLPPWLCLEDGTGIWGLVTAISLLLAQLVVISQHSTCVLCLQGRALIPPRMGLPPSGTLPGHSRVSVGRLSGSQPPLCPEVSCLSGVRVCHPPHGCREDAQTGLQPPCTHGGI

SEQ ID NO: 832179 - protein, 145 aa, Homo sapiens
SRIRHNGGALFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832180 - protein, 144 aa, Homo sapiens
KLMKKVFGKFFKATMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832181 - protein, 137 aa, Homo sapiens
ARYEAGVCIGRGEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832182 - protein, 144 aa, Homo sapiens
SAGRGRVSIGRGWTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832183 - protein, 170 aa, Homo sapiens
MEPCVKLNKASINMLRIVEPYIAWGYPNLKSVNELIYKRGYGQSVVPNSSLLLSFYPLSLLITSLAYFWISFPPFSSNIMKCLALVNVYARHITAEAPRPTGKQLGAWKPGLLNFKPGFLQVVVWGGWSGDRIELKDYANEEVSQGGFEKGTHILQAKSRLGDLGYYALA

SEQ ID NO: 832184 - protein, 145 aa, Homo sapiens; identical to SEQ ID NO: 832179

SEQ ID NO: 832185 - protein, 145 aa, Homo sapiens; identical to SEQ ID NO: 832179

SEQ ID NO: 832186 - protein, 162 aa, Homo sapiens
SPLQHWLTAALHPKVTAICGKPANSAIMAGGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832187 - protein, 332 aa, Homo sapiens
MPEGPLVRKFHHLVSPFVGQQVVKTGGSSKKLQPASLQSLWLQDTQVHGKKLFLRFDLDEEMGPPGSSPTPEPPQKEVQKEGAADPKQVGEPSGQKTLDGSSRSAELVPQGEDDSEYLERDAPAGDAGRWLRVSFGLFGSVWVNDFSRAKKANKRGDWRDPSPRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 832188 - protein, 332 aa, Homo sapiens; identical to SEQ ID NO: 832187

SEQ ID NO: 832189 - protein, 141 aa, Homo sapiens
MRQRPLFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832190 - protein, 145 aa, Homo sapiens; identical to SEQ ID NO: 832179

SEQ ID NO: 832191 - protein, 145 aa, Homo sapiens; identical to SEQ ID NO: 832179

SEQ ID NO: 832192 - protein, 144 aa, Homo sapiens; identical to SEQ ID NO: 832180

SEQ ID NO: 832193 - protein, 144 aa, Homo sapiens; identical to SEQ ID NO: 832182

SEQ ID NO: 832194 - protein, 137 aa, Homo sapiens; identical to SEQ ID NO: 832181

SEQ ID NO: 832195 - protein, 151 aa, Homo sapiens
RGFFYIKSVVRRSGLSTASHEGVEKEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832196 - protein, 332 aa, Homo sapiens; identical to SEQ ID NO: 832187

SEQ ID NO: 832197 - protein, 127 aa, Homo sapiens
VLGDLEDPEREKGRSVCRTLEKEGFESEISAEKSCQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832198 - protein, 143 aa, Homo sapiens
LTYVKKQLVARIFPPPGGYRRHLTEVRERESACELESEIRKRDQAPEKKLPKKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832199 - protein, 141 aa, Homo sapiens; identical to SEQ ID NO: 832189

SEQ ID NO: 832200 - protein, 141 aa, Homo sapiens; identical to SEQ ID NO: 832189

SEQ ID NO: 832201 - protein, 332 aa, Homo sapiens; identical to SEQ ID NO: 832187

SEQ ID NO: 832202 - protein, 332 aa, Homo sapiens; identical to SEQ ID NO: 832187

SEQ ID NO: 832203 - protein, 339 aa, Homo sapiens
GGGAPQPPPTGASPKGTEAAWAAEPGNLRPQLERLCGLRSGAGSGRRATHPEPVHGKKLFLRFDLDEEMGPPGSSPTPEPPQKEVQKEGAADPKQVGEPSGQKTLDGSSRSAELVPQGEDDSEYLERDAPAGDAGRWLRVSFGLFGSVWVNDFSRAKKANKRGDWRDPSPRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 832204 - protein, 73 aa, Homo sapiens
ELGTRVGSMQGCVCVGVCVQGCVRGFLAEPQLAYVIRIRGINGVSPKVRKVLQLLRLRQIFNGTLCEAQQGFD

SEQ ID NO: 832205 - protein, 80 aa, Homo sapiens
SRIRHNGGALFPAGTMEGVEEKKKEVPAVPETLKKKRRNFAELKIKRLRKKFAQKMLRKARRKLIYEKAKHYHKEYRQNQ

SEQ ID NO: 832206 - protein, 181 aa, Homo sapiens
MLRSILFLEWTREPEDSTDISSKSALQRLGHEVRPGCPLAAEQQYQPRGSLPAGPWARHASRCLKLTLLPTPKIGTPRGMDAATKRSDDKDLAERRKGCSLRLPRQGAGRAAKSDFELQLAVWNVAQEALIFLAGTVAAVLACGPGQPLPSRRAGEDWCMLGFVVRPHEARPGNIMGRNGA

SEQ ID NO: 832207 - protein, 145 aa, Homo sapiens; identical to SEQ ID NO: 832179

SEQ ID NO: 832208 - protein, 332 aa, Homo sapiens; identical to SEQ ID NO: 832187

SEQ ID NO: 832209 - protein, 145 aa, Homo sapiens; identical to SEQ ID NO: 832179

SEQ ID NO: 832210 - protein, 145 aa, Homo sapiens; identical to SEQ ID NO: 832179

SEQ ID NO: 832211 - protein, 145 aa, Homo sapiens; identical to SEQ ID NO: 832179

SEQ ID NO: 832212 - protein, 332 aa, Homo sapiens; identical to SEQ ID NO: 832187

SEQ ID NO: 832213 - protein, 339 aa, Homo sapiens; identical to SEQ ID NO: 832203

SEQ ID NO: 832214 - protein, 189 aa, Homo sapiens
MGYRGSPGGARSASPSCQRSQSSASSPKELVVLLMEPCRLGNLTSKCPHHSRRKLWLNHPLPSREKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832215 - protein, 145 aa, Homo sapiens; identical to SEQ ID NO: 832179

SEQ ID NO: 832216 - protein, 145 aa, Homo sapiens; identical to SEQ ID NO: 832179

SEQ ID NO: 832217 - protein, 175 aa, Homo sapiens
LSHGRGRNLSPPRTSLRSSRPLPWGVLASACRARQSAEPRPSSSGRPVPTGPWLATFRKLEHSRPPRLRSGAAEDSPVGWSDDKDLAERRKGCSLRLPRQGAGRAAKSDFELQLAVWNVAQEALIFLAGTVAAVLACGPGQPLPSRRAGEDWCMLGFVVRPHEARPGNIMGRNGA

SEQ ID NO: 832218 - protein, 143 aa, Homo sapiens
NYVYVRGLGCYVTLEGVKEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTLCEAQQGFD

SEQ ID NO: 832219 - protein, 145 aa, Homo sapiens; identical to SEQ ID NO: 832179

SEQ ID NO: 832220 - protein, 145 aa, Homo sapiens; identical to SEQ ID NO: 832179

SEQ ID NO: 832221 - protein, 90 aa, Homo sapiens
AGSYEWLVLCVEKAKHYHKEYRQMYRTEIRMARMARKAGNFYVPAEPKLAFVIRIRGINGVSPKVRKVLQLLRLRQIFNGTLCEAQQGFD

SEQ ID NO: 832222 - protein, 141 aa, Homo sapiens; identical to SEQ ID NO: 832189

SEQ ID NO: 832223 - protein, 147 aa, Homo sapiens
MEGVEEPKNAVLSVPTNTLSGKTRLNLHSLKIPRLLPDFCPNLYASDDGMVGRLSIAKEPSNLSHLHGILLGAKIGHMEDVMNSENGLEGMARKAGNFYVPAEPKLAFVIRIRGINGVSPKVRKVLQLLRLRQIFNGTLCEAQQGFD

SEQ ID NO: 832224 - protein, 107 aa, Homo sapiens
SRYCLLTNQLRKIIMVDTLVHSSNKPVDLVLPVASISTFYKMGGLFLSFHLVEKTFEAATGSYLPLAFVIRIRGINGVSPKVRKVLQLLRLRQIFNGTLCEAQQGFD

SEQ ID NO: 832225 - protein, 73 aa, Homo sapiens; identical to SEQ ID NO: 832204

SEQ ID NO: 832226 - protein, 332 aa, Homo sapiens; identical to SEQ ID NO: 832187

SEQ ID NO: 832227 - protein, 72 aa, Homo sapiens
PRARRNSARASINMLRIVEPYIAWGYPNLKSVNELIYKRGYGKINKKRIALTDNALMCSISVVNTASSAWRI

SEQ ID NO: 832228 - protein, 332 aa, Homo sapiens; identical to SEQ ID NO: 832187

SEQ ID NO: 832229 - protein, 332 aa, Homo sapiens; identical to SEQ ID NO: 832187

SEQ ID NO: 832230 - protein, 640 aa, Homo sapiens
SQWCGRQAAMAAVRGLRVSVKAEAPAGPALGLPSPEAESGVDRGEPEPMEVEEGELEIVPVRRSLKELIPDTSRRYENKAGSFITGIDVTSKEAIEKKEQRAKRFHFRSEVNLAQRNVALDRDMMKKAIPKVRLETIYICGVDEMSTQDVFSYFKEYPPAHIEWLDDTSCNVVWLDEMTATRALINMSSLPAQDKIRSRDASEDKSAEKRKKDKQEDSSDDDEAEEGEVEDENSSDVELDTLSQVEEESLLRNDLRPANKLAKGNRLFMRFATKAPGLGSIQDWVYDKKELGAARRSQYYMKYGNPNYGGMKGILSNSWKRRYHSRRIQRDVIKKRALIGDDVGLTSYKHRHSGLVNVPEEPIEEEEEEEEEEEEEEEEDQDMDADDRVVVEYHEELPALKQPRERSASRRSSASSSDSDEMDYDLELKMISTPSPKKSMKMTMYADEVESQLKNIRNSMRADSVSSSNIKNRIGNKLPPEKFADVRHLLDEKRQHSRPRPPVSSTKSDIRQRLGKRPHSPEKAFSSNPVVRREPSSDVHSRLGVPRQDSKGLYADTREKKSGNLWTRLGSAPKTKEKNTKKVDHRAPGAEEDDSELQRAWGALIKEKEQSRQKKSRLDNLPSLQIEVSRESSSGSEAES

SEQ ID NO: 832231 - protein, 283 aa, Homo sapiens
SQWCGRQAAMAAVRGLRVSVKAEAPAGPALGLPSPEAESGVDRGEPEPMEVEEGELEIVPVRRSLKELIPDTSRRYENKAGSFITGIDVTSKEAIEKKEQRAKRFHFRSEVNLAQRNVALDRDMMKKAIPKVRLETIYICGVDEMSTQDVFSYFKEYPPAHIEWLDDTSCNVVWLDEMTATRALINMSSLPAQDKIRSRDASEDKSAEKRKKDKQEDSSDDDEAEEGEVEDENSSDVELDTLSQVEEESLLRNDLRPANKLAKGNRLFMRFATKAPGLGSIQD

SEQ ID NO: 832232 - protein, 283 aa, Homo sapiens; identical to SEQ ID NO: 832231

SEQ ID NO: 832233 - protein, 75 aa, Homo sapiens
PLIYRNFEPRVPLRLWAQRFRGRVLMPLGPMAAALKPDILAQGGARSRNLPRRSWRPLAPAHTVTLRSCYFGKTS

SEQ ID NO: 832234 - protein, 283 aa, Homo sapiens; identical to SEQ ID NO: 832231

SEQ ID NO: 832235 - protein, 283 aa, Homo sapiens; identical to SEQ ID NO: 832231

SEQ ID NO: 832236 - protein, 340 aa, Homo sapiens
MKYGNPNYGGMKGILSNSWKRRYHSRRIQRDVIKKRALIGDDVGLTSYKHRHSGLVNVPEEPIEEEEEEEEEEEEEEEEDQDMDADDRVVVEYHEELPALKQPRERSASRRSSASSSDSDEMDYDLELKMISTPSPKKSMKMTMYADEVESQLKNIRNSMRADSVSSSNIKNRIGNKLPPEKFADVRHLLDEKRQHSRPRPPVSSTKSDIRQRLGKRPHSPEKAFSSNPVVRREPSSDVHSRLGVPRQDSKGLYADTREKKSGNLWTRLGSAPKTKEKNTKKVDHRAPGAEEDDSELQRAWGALIKEKEQSRQKKSRLDNLPSLQIEVSRESSSGSEAES

SEQ ID NO: 832237 - protein, 283 aa, Homo sapiens; identical to SEQ ID NO: 832231

SEQ ID NO: 832238 - protein, 283 aa, Homo sapiens; identical to SEQ ID NO: 832231

SEQ ID NO: 832239 - protein, 142 aa, Homo sapiens
ADRKILSSFLCLVFLAIPKVRLETIYICGVDEMSTQDVFSYFKEYPPAHIEWLDDTSCKYTRVSCEYAFVDDFSRVLAIRDGEWFWPILLVYAELLLLVQERKNCRAVKRSMPLPVCQLIPHSVPRQLRGGGQGSRRWVTGL

SEQ ID NO: 832240 - protein, 212 aa, Homo sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 832241 - protein, 212 aa, Homo sapiens; identical to SEQ ID NO: 832240

SEQ ID NO: 832242 - protein, 212 aa, Homo sapiens; identical to SEQ ID NO: 832240

SEQ ID NO: 832243 - protein, 212 aa, Homo sapiens; identical to SEQ ID NO: 832240

SEQ ID NO: 832244 - protein, 212 aa, Homo sapiens; identical to SEQ ID NO: 832240

SEQ ID NO: 832245 - protein, 194 aa, Homo sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWSVNPYLQGQRLDNVVAKKSVPHFSDEDKDPE

SEQ ID NO: 832246 - protein, 242 aa, Homo sapiens
RSERRLLSLMPSERRYTINKLLITVSQYDDVITRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 832247 - protein, 212 aa, Homo sapiens; identical to SEQ ID NO: 832240

SEQ ID NO: 832248 - protein, 226 aa, Homo sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRVTRAWLDCCGDAWSFLSGAVNRLKPSLVGKSQNPPLCSPEKHWSM

SEQ ID NO: 832249 - protein, 272 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKARGGGFALVWVPQALWFGCGAPPGWGARDARGGLPWARLGT

SEQ ID NO: 832250 - protein, 606 aa, Homo sapiens [sequence omitted]

SEQ ID NO: 832251 - protein, 606 aa, Homo sapiens [sequence omitted]

SEQ ID NO: 832252 - protein, 606 aa, Homo sapiens [sequence omitted]

SEQ ID NO: 832253 - protein, 589 aa, Homo sapiens
MVGGGGVIGRGGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832254 - protein, 606 aa, Homo sapiens [sequence omitted]

SEQ ID NO: 832255 - protein, 561 aa, Homo sapiens
MNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832256 - protein, 570 aa, Homo sapiens
AICLAGWAGANPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832257 - protein, 606 aa, Homo sapiens [sequence omitted]

SEQ ID NO: 832258 - protein, 542 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINILGLKEGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832259 - protein, 533 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSSLHMKNKAST

SEQ ID NO: 832260 - protein, 597 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRMFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832261 - protein, 594 aa, Homo sapiens [sequence omitted]

SEQ ID NO: 832262 - protein, 430 aa, Homo sapiens
DCGEGGSLIQDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832263 - protein, 236 aa, Homo sapiens [sequence omitted]

SEQ ID NO: 832264 - protein, 300 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVTVSPSCFDVPLSFPLLLSRAKVNLRTKMKSL

SEQ ID NO: 832265 - protein, 174 aa, Homo sapiens
MTGPSCLLWWGGGMGARHRNREMTCSAAVKLYVPDSVHPEAGAGARSRDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832266 - protein, 112 aa, Homo sapiens
RYPLWNAAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832267 - protein, 291 aa, Homo sapiens
RLGQPVLIGRGRNNPSKPLHVIKVTVNDGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHMHTGCTMSAAWPGWTSTRWSRPPMMPLSRSGQSPTEEPHPRLWMDRIRD

SEQ ID NO: 832268 - protein, 272 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKARGGGFALVWVPQALWFGCGAPPGLGARDARGGLPWARLGT

SEQ ID NO: 832269 - protein, 235 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGDWCSVERSCSVERR

SEQ ID NO: 832270 - protein, 141 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGRENLTFLFYKGYLYVGRI

SEQ ID NO: 832271 - protein, 606 aa, Homo sapiens [sequence omitted]

SEQ ID NO: 832272 - protein, 606 aa, Homo sapiens [sequence omitted]

SEQ ID NO: 832273 - protein, 537 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHQFAHEK

SEQ ID NO: 832274 - protein, 184 aa, Homo sapiens
MGSTVLDQQLGCLWQKDHLLSVSLSGYINYLDRNNPSKPLHVIKGTEIYVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFFSRAKVNLRTKMKSL

SEQ ID NO: 832275 - protein, 606 aa, Homo sapiens [sequence omitted]

SEQ ID NO: 832276 - protein, 607 aa, Homo sapiens
YNAKAIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832277 - protein, 606 aa, Homo sapiens [sequence omitted]

SEQ ID NO: 832278 - protein, 588 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832279 - protein, 606 aa, Homo sapiens [sequence omitted]

SEQ ID NO: 832280 - protein, 562 aa, Homo sapiens
MCRSQRMCRSQRMCRSQRMCRSQRMCRSIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832281 - protein, 466 aa, Homo sapiens
MPYEIKKVFASLPQVERGVSKIIGGDPKGNNFLYTNGKCVILRNIDDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832282 - protein, 592 aa, Homo sapiens
VLNSFVRRTQGSARPSHLPGPLHFKEAQAGLEEPVRSQRQGEAVLAKEAEFGSERTRCAGQRSRIRAVVMSWSRLCASSGRSSGAYTPVHPPPNRGSRSALPQALPPLPSLQPAPSCSSLGNCPVRPFDTGNVDPMDRHGQGTVGHVDTDRRWTPSANPDGNRPSVHDGSLMDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 832283 - protein, 580 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHMHTGCTMSAAWPGWTSTRWSRPPMMPLSRSGQSPTEEPHPRLWMDRIRD

SEQ ID NO: 832284 - protein, 483 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVRIRCVFAWTGRRGRRARG

SEQ ID NO: 832285 - protein, 335 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSRHRCISGRQHWLWQICSHQERIHTVDKAAVDANCELELE

SEQ ID NO: 832286 - protein, 220 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFSPDGNRFATASADGQIYIYDGRH

SEQ ID NO: 832287 - protein, 212 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTVGDHSRFVNCVRFFSRAKVNLRTKMKSL

SEQ ID NO: 832288 - protein, 177 aa, Homo sapiens
QGGDGVNSCSKDRWSLRWDVPFASSLLLGPGQQSLLLLLLCLWSVLVGQLKQLSSCLAVQGLGELVNRRRHFQPLIEDGSLPLQPDIAGPFHKAGEVSFGLDVLSNAKILRPFLKQGIHHFLSLLLLHDSWGRSHLLSLGLLSFRPLLLSRAKVMSKFLEPLLARPRCPGHRFTIML

SEQ ID NO: 832289 - protein, 142 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFFFLVNLGILLPTPTL

SEQ ID NO: 832290 - protein, 60 aa, Homo sapiens
SVNSVVSTFPMGSTVLDQQLGCLWQKDHLLSVSLSGYINYLDRNNPSKPLHVIKVRPALG

SEQ ID NO: 832291 - protein, 158 aa, Homo sapiens
TSRDVNLAEEQTPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 832292 - protein, 163 aa, Homo sapiens
AAVVYRIPDDLDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 832293 - protein, 116 aa, Homo sapiens
MEKMRPTTTEPTQTDAKSNPNHPSSSGSFSDADLADGVSGGEGKGGSDGGGSHRKEGEEADAPGVIPGIVGAVVVAVAGAISSFIAYQNLGCLQITCPSSTSETPGSPDFFLIKIR

SEQ ID NO: 832294 - protein, 248 aa, Homo sapiens
FCARVEARGGAGAAGAELAGPLPSPAPFESPGFAPPGPWGSICPAAFAHALHSGTVPARSGRTMARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 832295 - protein, 215 aa, Homo sapiens
GRVGRPTRICPAAFAHALHSGTVPARSGRTMARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 832296 - protein, 248 aa, Homo sapiens; identical to SEQ ID NO: 832294

SEQ ID NO: 832297 - protein, 248 aa, Homo sapiens; identical to SEQ ID NO: 832294

SEQ ID NO: 832298 - protein, 147 aa, Homo sapiens
NSADIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 832299 - protein, 168 aa, Homo sapiens [sequence omitted]

SEQ ID NO: 832300 - protein, 170 aa, Homo sapiens
MVGVSDSNSSSSLLYDLTEYSHRESTAFPNRHSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 832301 - protein, 232 aa, Homo sapiens
FCARVEARGGAGAAGAELAGPLPSPAPFESPGFAPPGPWGSICPAAFAHALHSGTVPARSGRTMARGAALALLLFGLLGVLVAAPDGGFDLSDALPGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 832302 - protein, 248 aa, Homo sapiens; identical to SEQ ID NO: 832294

SEQ ID NO: 832303 - protein, 248 aa, Homo sapiens; identical to SEQ ID NO: 832294

SEQ ID NO: 832304 - protein, 204 aa, Homo sapiens
FCARVEARGGAGAAGAELAGPLPSPAPFESPGFAPPGPWGSICPAAFAHALHSGTVPARSGRTMARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGA

SEQ ID NO: 832305 - protein, 248 aa, Homo sapiens; identical to SEQ ID NO: 832294

SEQ ID NO: 832306 - protein, 163 aa, Homo sapiens; identical to SEQ ID NO: 832292

SEQ ID NO: 832307 - protein, 175 aa, Homo sapiens
RRRRRRRRRRRRRGGFDLSDVLPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 832308 - protein, 158 aa, Homo sapiens; identical to SEQ ID NO: 832291

SEQ ID NO: 832309 - protein, 168 aa, Homo sapiens
FCARVEARGGAGAAGAELAGPLPSPAPFESPGFAPPGPWGSICPAAFAHALHSGTVPARSGRTMARGAALALLLFGLLGVLVAAPDGGFDLSDALPDNENKKPTAIPKKPSAGDDFDLGDAVVDGENDDPRPPNPPKPMPNPNPNHPSSSGFSDANAEPAVQRTLLEK

SEQ ID NO: 832310 - protein, 247 aa, Homo sapiens
FCARVEARGGAGAAGAELAGPLPSPAPFESPGFAPPGPWGSICPAAFAHALHSGTVPARSGRTMARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAGKKDGER

SEQ ID NO: 832311 - protein, 237 aa, Homo sapiens
FCARVEARGGAGAAGAELAGPLPSPAPFESPGFAPPGPWGSICPAAFAHALHSGTVPARSGRTMARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENGQLAGSLGPCIGIRRE

SEQ ID NO: 832312 - protein, 144 aa, Homo sapiens
MAPKKAKKRAGGANSNVFSMFEQTQIQEFKEAFTIMDQNRDGFIDKNDLRDTFAALGRVNVKNEEIDEMIKEAPGPINFTVFLTMFGEKLKGADPEETILNAFKVFDPEGKGVLKADYVREMLTTQAERFSKEEVDQMFAAFPP

SEQ ID NO: 832313 - protein, 161 aa, Homo sapiens
GLQEFNFVGRQCWVLSTMAPKKAKKRAGGANSNVFSMFEQTQIQEFKEAFTIMDQNRDGFIDKNDLRDTFAALGRVNVKNEEIDEMIKEAPGPINFTVFLTMFGEKLKGADPEETILNAFKVFDPEGKGVLKADYVREMLTTQAERFSKEEVDQMFAAFPP

SEQ ID NO: 832314 - protein, 119 aa, Homo sapiens
MAPKKAKKRAGGANSNVFSMFEQTQIQEFKEAFTIMDQNRDGFIDKNDLRDTFAALGRVNVKNEEIDEMIKEAPGPINFTVFLTMFGEKLKGADPEETILNAFKVFDPEGKGVLKADYT

SEQ ID NO: 832315 - protein, 118 aa, Homo sapiens
MTAKSGHGVIFKHGEEVFIVPGLQRAGRSVEFFSGGSAGSFPPWHLRKQRREPGAPTPTCSPCSNRPKSRNLRRWVQLLNHPPGWKSHPRGRTFFLFHIPSRDLSLDASILQTIPNSA

SEQ ID NO: 832316 - protein, 144 aa, Homo sapiens; identical to SEQ ID NO: 832312

SEQ ID NO: 832317 - protein, 144 aa, Homo sapiens; identical to SEQ ID NO: 832312

SEQ ID NO: 832318 - protein, 104 aa, Homo sapiens
MGVGVFVECGGIIWLPWRVNVKNEEIDEMIKEAPGPINFTVFLTMFGEKLKGADPEETILNAFKVFDPEGKGVLKADYVREMLTTQAERFSKEEVDQMFAAFPP

SEQ ID NO: 832319 - protein, 130 aa, Homo sapiens
MAPKKAKKRAGGANSNVFSMFEQTQIQEFKELGVPECVFPTLGRVNVKNEEIDEMIKEAPGPINFTVFLTMFGEKLKGADPEETILNAFKVFDPEGKGVLKADYVREMLTTQAERFSKEEVDQMFAAFPP

SEQ ID NO: 832320 - protein, 180 aa, Homo sapiens
SCASVETACRAGTCWVLATVDNLVTSKKYSLVDVTIALENCRSPPCYRSQQAEESRDVSGRPPGSHGTRNRAWIHPTGSDLKRRTIAALCRERRVNVKNEEIDEMIKEAPGPINFTVFLTMFGEKLKGADPEETILNAFKVFDPEGKGVLKADYVREMLTTQAERFSKEEVDQMFAAFPP

SEQ ID NO: 832321 - protein, 123 aa, Homo sapiens
MAPKKAKKRAGGANSNVFSMFEQTQIQEFKEAFTIMDQNRDGFIDKNDLRDTFAALGSEREKLTFGEKLKGADPEETILNAFKVFDPEGKGVLKADYVREMLTTQAERFSKEEVDQMFAAFPP

SEQ ID NO: 832322 - protein, 144 aa, Homo sapiens; identical to SEQ ID NO: 832312

SEQ ID NO: 832323 - protein, 103 aa, Homo sapiens
MVSTRAPGGDDAGWARRGSHYKRGTTAEGEEGGPQSLQPLVEKAPLTARAQRNPNQCPDRPQITAALGDSQTQNKRVGFFMACLLTSRGINNSQDLQNGIECF

SEQ ID NO: 832324 - protein, 144 aa, Homo sapiens; identical to SEQ ID NO: 832312

SEQ ID NO: 832325 - protein, 144 aa, Homo sapiens; identical to SEQ ID NO: 832312

SEQ ID NO: 832326 - protein, 161 aa, Homo sapiens; identical to SEQ ID NO: 832313

SEQ ID NO: 832327 - protein, 131 aa, Homo sapiens
TTASGSACMGIPKSMGLRAFTIMDQNRDGFIDKNDLRDTFAALGRVNVKNEEIDEMIKEAPGPINFTVFLTMFGEKLKGADPEETILNAFKVFDPEGKGVLKADYVREMLTTQAERFSKEEVDQMFAAFPP

SEQ ID NO: 832328 - protein, 102 aa, Homo sapiens
TPGFSKSDVCKNAGRLIEKRLPKGRIGNGPPPRSQFGTSFLGAAYGGGSHLLLGIMAALRPLVKPQDRQKENPRSSSGTQSDRYVKIKRNWRKPRGIDNRVP

SEQ ID NO: 832329 - protein, 82 aa, Homo sapiens
TRKATGTQCWNTLGFARTVKLRINVGRCSHLLLGIMAALRPLVKPQDRQKENPRSSSGTQSDRYVKIKRNWRKPRGIDNRVP

SEQ ID NO: 832330 - protein, 56 aa, Homo sapiens
MPVLKRQSAVARGYKGLGLVNLASWNFGEETLLLGVDLIGHLPRDLTVQEYTSVIG

SEQ ID NO: 832331 - protein, 105 aa, Homo sapiens
LPCPAAGSAAPWESFRAGAGFGPGSAARPTRSTPGDSRGALRRPGLLGAGPRAAVGPTGFRRRFKGQILMPNIGYGSNKKTKHMLAQWLSGSSWVHNVKELGSAA

SEQ ID NO: 832332 - protein, 79 aa, Homo sapiens
RYSSAPRYSSAPSQTDMSKLSVTGGNPEALTTGFRRRFKGQILMPNIGYGSNKKTKHMLAQWLSGSSWVHNVKELGSAA

SEQ ID NO: 832333 - protein, 75 aa, Homo sapiens
AAPTTTKLTRSTFLGAAYGGGSHLLLGIMAALRPLVKPQDRQKENPRSSSGTQSDRYVKIKRNWRKPRGIDNRVP

SEQ ID NO: 832334 - protein, 102 aa, Homo sapiens; identical to SEQ ID NO: 832328

SEQ ID NO: 832335 - protein, 76 aa, Homo sapiens
TTHQPLRATVPSLFLGAAYGGGSHLLLGIMAALRPLVKPQDRQKENPRSSSGTQSDRYVKIKRNWRKPRGIDNRVP

SEQ ID NO: 832336 - protein, 76 aa, Homo sapiens; identical to SEQ ID NO: 832335

SEQ ID NO: 832337 - protein, 76 aa, Homo sapiens; identical to SEQ ID NO: 832335

SEQ ID NO: 832338 - protein, 134 aa, Homo sapiens
AGFFQVRRLENAGRLIEKRLPKGRIGNGPPLGPNSARASSALPTEVAAISFSVSVNPWQSAFLRDSSGPVAQWCGGLPFSAVVSVGIVIVSLLERVQEQNEAAELIGLCVPEPPALRLYSELRAACLFLGGGGC

SEQ ID NO: 832339 - protein, 134 aa, Homo sapiens; identical to SEQ ID NO: 832338

SEQ ID NO: 832340 - protein, 112 aa, Homo sapiens
MANWERAPPRSQFGTSFLGAAYGGGSHLLLAGDWKTLCDSVQSLGRKASFQDSSSPGAASSPKGIMAALRPLVKPQDRQKENPRSSSGTQSDRYVKIKRNWRKPRGIDNRVP

SEQ ID NO: 832341 - protein, 82 aa, Homo sapiens; identical to SEQ ID NO: 832329

SEQ ID NO: 832342 - protein, 76 aa, Homo sapiens; identical to SEQ ID NO: 832335

SEQ ID NO: 832343 - protein, 82 aa, Homo sapiens; identical to SEQ ID NO: 832329

SEQ ID NO: 832344 - protein, 76 aa, Homo sapiens; identical to SEQ ID NO: 832335

SEQ ID NO: 832345 - protein, 76 aa, Homo sapiens; identical to SEQ ID NO: 832335

SEQ ID NO: 832346 - protein, 76 aa, Homo sapiens; identical to SEQ ID NO: 832335

SEQ ID NO: 832347 - protein, 102 aa, Homo sapiens; identical to SEQ ID NO: 832328

SEQ ID NO: 832348 - protein, 120 aa, Homo sapiens
MGRAPKRRGGNKFQNGGYPQNKQESKKKAEEARHGTAEPKRGGPPGTTAGRRDKRDPATDTARPNQNKQRETEHKQHHTTAKSRPATTKDNSTRNRHLRTGNNTKSNEHPTPSHAATRAD

SEQ ID NO: 832349 - protein, 82 aa, Homo sapiens; identical to SEQ ID NO: 832329

SEQ ID NO: 832350 - protein, 102 aa, Homo sapiens; identical to SEQ ID NO: 832328

SEQ ID NO: 832351 - protein, 102 aa, Homo sapiens; identical to SEQ ID NO: 832328

SEQ ID NO: 832352 - protein, 125 aa, Homo sapiens
MSKLSVTGGNPEALTTGFRRRFKGQILMPNIGYGSNKKTKHMLAQWLSGSSWVHNVKELAGWRLAPQVPSEAFLGEETPFMRNEFAWVTLAMLGVRVHPLTPPSSLPNPQLRVVSNMALMINGFT

SEQ ID NO: 832353 - protein, 76 aa, Homo sapiens; identical to SEQ ID NO: 832335

SEQ ID NO: 832354 - protein, 74 aa, Homo sapiens
KNRLGSEAGWFFLGAAYGGGSHLLLGIMAALRPLVKPQDRQKENPRSSSGTQSDRYVKIKRNWRKPRGIDNRVP

SEQ ID NO: 832355 - protein, 76 aa, Homo sapiens; identical to SEQ ID NO: 832335

SEQ ID NO: 832356 - protein, 94 aa, Homo sapiens
AAPTTTKLTTLDWKQQKNKAHACPVAFRKFLGPQRQGAGKCCLMCNKIFTCCRDRFTSVFPPRNRKAIRGKGAAQLGHQSSPTPMPSACAVEEQ

SEQ ID NO: 832357 - protein, 103 aa, Homo sapiens
MTKPLICTLQLGDKWGQEGSSCREKKKTRDIHCDILGTLSQSCPLDHRHCTDLREWQVQVPLLGGDEKGERARGTKRMRRHEFRDDPTGPSEFTNPNAQRVRS

SEQ ID NO: 832358 - protein, 76 aa, Homo sapiens; identical to SEQ ID NO: 832335

SEQ ID NO: 832359 - protein, 76 aa, Homo sapiens; identical to SEQ ID NO: 832335

SEQ ID NO: 832360 - protein, 76 aa, Homo sapiens; identical to SEQ ID NO: 832335

SEQ ID NO: 832361 - protein, 76 aa, Homo sapiens; identical to SEQ ID NO: 832335

SEQ ID NO: 832362 - protein, 134 aa, Homo sapiens; identical to SEQ ID NO: 832338

SEQ ID NO: 832363 - protein, 74 aa, Homo sapiens; identical to SEQ ID NO: 832354

SEQ ID NO: 832364 - protein, 76 aa, Homo sapiens; identical to SEQ ID NO: 832335

SEQ ID NO: 832365 - protein, 120 aa, Homo sapiens; identical to SEQ ID NO: 832348

SEQ ID NO: 832366 - protein, 76 aa, Homo sapiens; identical to SEQ ID NO: 832335

SEQ ID NO: 832367 - protein, 76 aa, Homo sapiens; identical to SEQ ID NO: 832335

SEQ ID NO: 832368 - protein, 71 aa, Homo sapiens
AAPTTTKLTTLDSVTGGNPEALTTGFRRRFKGQILMPNIGYGSNKKTKHMLAQWLSGSSWVHNVKELGSAA

SEQ ID NO: 832369 - protein, 91 aa, Homo sapiens
SGARPGAPPGRAAPPRGARRREARATGAGADAAAAPRRHPGAAAGFRRRFKGQILMPNIGYGSNKKTKHMLAQWLSGSSWVHNVKELGSAA

SEQ ID NO: 832370 - protein, 102 aa, Homo sapiens; identical to SEQ ID NO: 832328

SEQ ID NO: 832371 - protein, 134 aa, Homo sapiens; identical to SEQ ID NO: 832338

SEQ ID NO: 832372 - protein, 863 aa, Homo sapiens
ALDQFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQTKSQCLSVEQSTIFMLSQTSSSLSFCWNKSPGYQSTCPSAAWYSSHSQQVTLAAWKEKVSTEPPPILGGSHHHCSSIPSHSCPRSRVGMLV

SEQ ID NO: 832373 - protein, 754 aa, Homo sapiens
ALDQFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFHNRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQTKSQCLSVEQSTIFMLSQTSSSLSF

SEQ ID NO: 832374 - protein, 854 aa, Homo sapiens
ALDQFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQNGCAQPRDRDSEFTPLASLQSPGYQSTCPSAAWYSSHSQQVTLAAWKEKVSTEPPPILGGSHHHCSSIPSHSCPRSRVGMLV

SEQ ID NO: 832375 - protein, 793 aa, Homo sapiens
ALDQFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVAAGESCRHHRGPAEGRDQSLGSHGRQDGDGRGTCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQNGCAQPRDRDSEFTPLASLQSPGYQSTCPSAAWYSSHSQQVTLAAWKEKVSTEPPPILGGSHHHCSSIPSHSCPRSRVGMLV

SEQ ID NO: 832376 - protein, 854 aa, Homo sapiens; identical to SEQ ID NO: 832374

SEQ ID NO: 832377 - protein, 854 aa, Homo sapiens; identical to SEQ ID NO: 832374

SEQ ID NO: 832378 - protein, 854 aa, Homo sapiens; identical to SEQ ID NO: 832374

SEQ ID NO: 832379 - protein, 476 aa, Homo sapiens
ALDQFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQVLPARPR

SEQ ID NO: 832380 - protein, 93 aa, Homo sapiens
RPCPVCGVQKAFLQLLHLRLLGVIGKEGRQAARNSDYAIPKFKHLKKMLLVHGHFYYIRISELVQYFFYKVGGSPLPLTVLATGHAQGGTTLV

SEQ ID NO: 832381 - protein, 124 aa, Homo sapiens
MVLSLWRLCTCLFLAPSRQGGGSQALPSSMAPWPPGPSTVVVEPHQWPLGIRLNAGGTFCWPTLRAVMQRPFPQACVFTHLPSLAFAVTGREEPSRDPWWPTCGCHMLLFPACPATTHALHRVR

SEQ ID NO: 832382 - protein, 797 aa, Homo sapiens
ALDQFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQTKSQCLSVEQSTIFMLSQTSSSLSF

SEQ ID NO: 832383 - protein, 854 aa, Homo sapiens; identical to SEQ ID NO: 832374

SEQ ID NO: 832384 - protein, 854 aa, Homo sapiens; identical to SEQ ID NO: 832374

SEQ ID NO: 832385 - protein, 116 aa, Homo sapiens
WEDTPHPAALCVSPEEGPGLPQPFCCGELHSYQMESREHPCGRCDLLHFSFRFELLEILSFDSVRRRMSVIVKSATGKISFSFDLLSYTWWLCFILMTKFYRSFKDLGFKNDLFFF

SEQ ID NO: 832386 - protein, 121 aa, Homo sapiens
LSGHPWEDTPHPAALCVSPEEGPGLPQPFCCGELHSYQMESREHPCGRCDLLHFSFRFELLEILSFDSVRRRMSVIVKSATGKISFSFDLLSYTWWLCFILMTKFYRSFKDLGFKNDLFFF

SEQ ID NO: 832387 - protein, 165 aa, Homo sapiens
IGDGANDVSMILEAHVGIGELRPCCWHILVARSPLRYDKGPWQHAGAFRTPPSPPSCVTGKAHDDGFIRSSPRPCPVCGVQKAFLQLLHLRLLGVIGKEGRQAARNSDYAIPKFKHLKKMLLVHGHFYYIRISELVQYFFYKVGGSPLPLTVLATGHAQGGTTLV

SEQ ID NO: 832388 - protein, 517 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSALFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 832389 - protein, 517 aa, Homo sapiens; identical to SEQ ID NO: 832388

SEQ ID NO: 832390 - protein, 517 aa, Homo sapiens; identical to SEQ ID NO: 832388

SEQ ID NO: 832391 - protein, 499 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSALFMAKKKTPPKRERKPSGGSSRGNSRPGTPSAEWVGHAPSLQTLLGWAAQGAQKKKKTLFFPHERGTHTNKNRRRRTHTPKRREKRCGEAGGDAGGKKKTTPRRPQDGERGRERFFFAGQTAEAPHRGGNKDAGGTQRF

SEQ ID NO: 832392 - protein, 585 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVIEQSDSSEREQGTPPRHDTRSAGQTAARSRDSSQRERTLPREALLSPLHADQPRPPTTERRGRRRRGSSKESNTSDTAIPQRAAQGGTTLHHTLQAACQATPPSQGRSRDDRRCPYNTNETQKMDHRGPRAGLTEARLNNPSPPNQGQRNTPTTVRSYTVHVHDCQGPIPHSGKPRPARPAVKRPHRRPRSQDTLPTSLNTTTYNNHTHQHRYPTTPHQQQLSHIEYHKKSRSLLLPSRTTRHSSPTTKQLARIHTHLTQRPFLSYTTLPVAPTNTKPYLHTPP

SEQ ID NO: 832393 - protein, 490 aa, Homo sapiens
MAALGPSSQNVTEYVVRVPKNTTKKYNIMAFNAADKVNFATWNQARLERDLSNKKIYQEEEMPESGAGSEFNRKLREEARRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSALFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 832394 - protein, 504 aa, Homo sapiens
IFFFRCESYIMKNQTVPIQVFHCFLKANVEQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSALFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 832395 - protein, 162 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEPDST

SEQ ID NO: 832396 - protein, 172 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPLTLTKGLCCPLGNFYSSPFHFPKSLFSCDLSTT

SEQ ID NO: 832397 - protein, 517 aa, Homo sapiens; identical to SEQ ID NO: 832388

SEQ ID NO: 832398 - protein, 130 aa, Homo sapiens
PFGVGGGNEPQTDPWGAKRRFDPTRVGLGCYGDAAFWAPQVQSGKAHAQSAWEPARGIRLPLPTQDAPRSLGADVTREGGPPFDEVNRVIYKSASDRGPLVYLRLGLGLLSLKRDRGGPFEVTIAAEEHK

SEQ ID NO: 832399 - protein, 517 aa, Homo sapiens; identical to SEQ ID NO: 832388

SEQ ID NO: 832400 - protein, 542 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGRRWLGGPGRWGRCFPALAHTLPLPGVDEQSDSSEESEEEKPPEEDKEEEEEKKAPTPQEKKRRKDSSEESDSSEESDIDSEASSALFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 832401 - protein, 517 aa, Homo sapiens; identical to SEQ ID NO: 832388

SEQ ID NO: 832402 - protein, 334 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 832403 - protein, 274 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGAESPRPRRRRLVEYSGATMAHCELNLLGSSKFPKSHPTATQRGTEL

SEQ ID NO: 832404 - protein, 175 aa, Homo sapiens [sequence omitted]

SEQ ID NO: 832405 - protein, 167 aa, Homo sapiens
YPRKVRLTSYKMAKEAIFQDTMRKFLEQECNVLPLKLLMPQCNQVLDDYFPLVIDYFQNQTVRAASSPPACLPTQAPVPTHGEPHTQHPSQPDTHTHTHTHSTQAGQTQTHSTPASRNTHTHTHNTPAGRTHTHTVPQLAGHTHTQHPIQTHTHTQYPSQLETHTHT

SEQ ID NO: 832406 - protein, 221 aa, Homo sapiens
MDEMGQVGLVGSCMCLGVLCWPLPKRTSPLELGASPTHVSSTLGPLHPQDDLCQECEDIVHILNKMAKEAIFQDTMRKFLEQECNVLPLKLLMPQCNQVLDDYFPLVIDYFQNQTVRAASSPPACLPTQAPVPTHGEPHTQHPSQPDTHTHTHTHSTQAGQTQTHSTPASRNTHTHTHNTPAGRTHTHTVPQLAGHTHTQHPIQTHTHTQYPSQLETHTHT

SEQ ID NO: 832407 - protein, 393 aa, Homo sapiens
MHQAGYPGCRGAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 832408 - protein, 393 aa, Homo sapiens; identical to SEQ ID NO: 832407

SEQ ID NO: 832409 - protein, 244 aa, Homo sapiens
MHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 832410 - protein, 393 aa, Homo sapiens; identical to SEQ ID NO: 832407

SEQ ID NO: 832411 - protein, 117 aa, Homo sapiens
MLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 832412 - protein, 142 aa, Homo sapiens [sequence omitted]

SEQ ID NO: 832413 - protein, 142 aa, Homo sapiens [sequence omitted]

SEQ ID NO: 832414 - protein, 142 aa, Homo sapiens [sequence omitted]

SEQ ID NO: 832415 - protein, 393 aa, Homo sapiens; identical to SEQ ID NO: 832407

SEQ ID NO: 832416 - protein, 393 aa, Homo sapiens; identical to SEQ ID NO: 832407

SEQ ID NO: 832417 - protein, 194 aa, Homo sapiens
MDEMGQVGLVGSCMCLGVLCWPLPKRTSPLELGASPTHVSSTLGPLHPQDDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLDLHFTGCGGLPHLCVRPRPRLEGPGQHREDELVQGTEL

SEQ ID NO: 832418 - protein, 393 aa, Homo sapiens; identical to SEQ ID NO: 832407

SEQ ID NO: 832419 - protein, 393 aa, Homo sapiens; identical to SEQ ID NO: 832407

SEQ ID NO: 832420 - protein, 393 aa, Homo sapiens; identical to SEQ ID NO: 832407

SEQ ID NO: 832421 - protein, 244 aa, Homo sapiens; identical to SEQ ID NO: 832409

SEQ ID NO: 832422 - protein, 450 aa, Homo sapiens
MHQAGYPGCRGAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPSEPTAPSLAQCLLSSSPYPATAYPLPLWSHCNAPRRTETKHLCRVALPAFPLMLTSPGSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 832423 - protein, 232 aa, Homo sapiens [sequence omitted]

SEQ ID NO: 832424 - protein, 170 aa, Homo sapiens
SLGLLLPLLQAMQFGWKAFILMVLHGDCMVTRLFPCSLALASCQAEKKPQLPHRPPHRPSSAVTSTGGPRAPSPVSALSVSAQPQSDTRAHFHPLWCEAQRGQHLEELCSLHTYHDLPGLGSGKTSHCFTGQGVEAEPRLTPTPMHSKIGFYSYLQFKIQKNKKWEHTEL

SEQ ID NO: 832425 - protein, 393 aa, Homo sapiens; identical to SEQ ID NO: 832407

SEQ ID NO: 832426 - protein, 319 aa, Homo sapiens
MHQAGYPGCRGAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPSEPTAPSLAQCLLSSSPYPATA

SEQ ID NO: 832427 - protein, 145 aa, Homo sapiens
MHQAGYPGCRGAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIGSHMSPDFL

SEQ ID NO: 832428 - protein, 104 aa, Homo sapiens
GIFSICCWLNPQMQNPRIWRAKEAFTEEGQCRFMKTKEGDLKQEDLIHSFKGCKGGKLKKRLRGHVKVIKHHPERNSAEQSVQNPCFHYQKPKTLSQYDMNLPI

SEQ ID NO: 832429 - protein, 758 aa, Homo sapiens
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 832430 - protein, 795 aa, Homo sapiens
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRDPSEGEASGRTDTSRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 832431 - protein, 670 aa, Homo sapiens
MKILNHPNIVKLFEVIETEKTLYLVMEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 832432 - protein, 780 aa, Homo sapiens
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 832433 - protein, 780 aa, Homo sapiens; identical to SEQ ID NO: 832432

SEQ ID NO: 832434 - protein, 780 aa, Homo sapiens; identical to SEQ ID NO: 832432

SEQ ID NO: 832435 - protein, 860 aa, Homo sapiens
MGEVTAEEVEKFLDSNIGFAKQYYNLHYRAKLISDLLGAKEAAVDFSNYHSPSSMEESEIIFDLLRDFQENLQTEKCIFNVMKKLCFLLQADRMSLFMYRTRNGIAELATRLFNVHKDAVLEDCLVMPDQEIVFPLDMGIVGHVAHSKKIANVPNTEEDEHFCDFVDILTEYKTKNILASPIMNGKDVVAIIMAVNKVDGSHFTKRDEEILLKYLNFANLIMKVYHLSYLHNCETRRGQILLWSGSKVFEELTDIERQFHKALYTVRAFLNCDRYSVGLLDMTKQKEFFDVWPVLMGEVPPYSGPRTPDGREINFYKVIDYILHGKEDIKVIPNPPPDHWALVSGLPAYVAQNGLICNIMNAPAEDFFAFQKEPLDESGWMIKNVLSMPIVNKKEEIVGVATFYNRKDGKPFDEMDETLMESLTQFLGWSVLNPDTYESMNKLENRKDIFQDIVKYHVKCDNEEIQKILKTREVYGKEPWECEEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAKMKVQEEKKQKQQSAKSAAAGNQPGGNPSPGGATTSKSCCIQ

SEQ ID NO: 832436 - protein, 543 aa, Homo sapiens
ECECLGQEHGVSENGIQCFTGHPLRPNHTFIIPLHCSQICNIMNAPAEDFFAFQKEPLDESGWMIKNVLSMPIVNKKEEIVGVATFYNRKDGKPFDEMDETLMESLTQFLGWSVLNPDTYESMNKLENRKDIFQDIVKYHVKCDNEEIQKILKTREVYGKEPWECEEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAKMKVQEEKKQKQQSAKSAAAGNQPGGNPSPGGATTSKSCCIQ

SEQ ID NO: 832437 - protein, 315 aa, Homo sapiens
MGEVTAEEVEKFLDSNIGFAKQYYNLHYRAKLISDLLGAKEAAVDFSNYHSPSSMEESEIIFDLLRDFQENLQTEKCIFNVMKKLCFLLQADRMSLFMYRTRNGIAELATRLFNVHKDAVLEDCLVMPDQEIVFPLDMGIVGHVAHSKKIANVPNTEEDEHFCDFVDILTEYKTKNILASPIMNGKDVVAIIMAVNKVDGSHFTKRDEEILLKYLNFANLIMKVYHLSYLHNCETRRGQILLWSGSKVFEELTDIERQFHKALYTVRAFLNCDRYSVGLLDMTKQKEFFDVWPVLMGEVPPYSGPRTPDGRVRSL

SEQ ID NO: 832438 - protein, 269 aa, Homo sapiens
MVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAKMKVQEEKKQKQQSAKSAAAGNQPGGNPSPGGATTSKSCCIQ

SEQ ID NO: 832439 - protein, 734 aa, Homo sapiens
MGEVTAEEVEKFLDSNIGFAKQYYNLHYRAKLISDLLGAKEAAVDFSNYHSPSSMEESEIIFDLLRDFQENLQTEKCIFNVMKKLCFLLQADRMSLFMYRTRNGIAELATRLFNVHKDAVLEDCLVMPDQEIVFPLDMGIVGHVAHSKKIANVPNTEEDEHFCDFVDILTEYKTKNILASPIMNGKDVVAIIMAVNKVDGSHFTKRDEEILLKYLNFANLIMKVYHLSYLHNCETRRGQILLWSGSKVFEELTDIERQFHKALYTVRAFLNCDRYSVGLLDMTKQKEFFDVWPVLMGEVPPYSGPRTPDGREINFYKVIDYILHGKEDIKVIPNPPPDHWALVSGLPAYVAQNGLICNIMNAPAEDFFAFQKEPLDESGWMIKNVLSMPIVNKKEEIVGVATFYNRKDGKPFDEMDETLMESLTQFLGWSVLNPDTYESMNKLENRKDIFQDIVKYHVKCDNEEIQKILKTREVYGKEPWECEEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQV

SEQ ID NO: 832440 - protein, 94 aa, Homo sapiens
ENLQTEKCIFNVMKKLCFLLQADRMSLFMYRTRNGIAELATRLFNVHKDAVLEDCLVMPDQEIVFPLDMGIVGHVAHSKKIANVPNTEEVLSSP

SEQ ID NO: 832441 - protein, 463 aa, Homo sapiens
LVPEAGSAESFPREAARLCSPVSGVPLRPARVSVSTCVRAPAVSSARPRGAVGGGAPGAPPPPMAAEIQPKPLTRKPILLQRMEGSQEVVNMAVIVPKEEGVISVSEDRTVRVWLKRDSGQYWPSVYHAMPSPCSCMSFNPETRRLSIGLDNGTISEFILSEDYNKMTPVKNYQAHQSRVTMILFVLELEWVLSTGQDKQFAWHCSESGQRLGGYRTSAVASGLQFDVETRHVFIGDHSGQVTILKLEQENCTLVTTFRGHTGGVTALCWDPVQRVLFSGSSDHSVIMWDIGGRKGTAIELQGHNDRVQALSYAQHTRQLISCGGDGGIVVWNMDVERQETPEWLDSDSCQKCDQPFFWNFKQMWDSKKIGLRQHHCRKCGKAVCGKCSSKRSSIPLMGFEFEVRVCDSCHEAITDEERAPTATFHDSKHNIVHVHFDATRGWLLTSGTDKVIKLWDMTPVVS

SEQ ID NO: 832442 - protein, 353 aa, Homo sapiens
LVPEAGSAESFPREAARLCSPVSGVPLRPARVSVSTCVRAPAVSSARPRGAVGGGAPGAPPPPMAAEIQPKPLTRKPILLQRMEGSQEVVNMAVIVPKEEGVISVSEDRTVRVWLKRDSGQYWPSVYHAMPSPCSCMSFNPETRRLSIGLDNGTISEFILSEDYNKMTPVKNYQAHQSRVTMILFVLELEWVLSTGQDKQFAWHCSESGQRLGGYRTSAVASGLQFDVETRHVFIGDHSGQVTILKLEQENCTLVTTFRGHTGGVTALCWDPVQRVLFSGSSDHSVIMWDIGGRKGTAIELQGHNDRVQALSYAQHTRQLISCGGDGGIVVWNMDVERQEPLWSCFVVMISAV

SEQ ID NO: 832443 - protein, 469 aa, Homo sapiens
LVPEAGSAESFPREAARLCSPVSGVPLRPARVSVSTCVRAPAVSSARPRGAVGGGAPGAPPPPMAAEIQPKPLTRKPILLQRMEGSQEVVNMAVIVPKEEGVISVSEDRTVRVWLKRDSGQYWPSVYHAMPSPCSCMSFNPETRRLSIGLDNGTISEFILSEDYNKMTPVKNYQAHQSRVTMILFVLELEWVLSTGQDKQFAWHCSESGQRLGGYRTSAVASGLQFDVETRHVFIGDHSGQVTILKLEQENCTLVTTFRGHTGGVTALCWDPVQRVLFSGSSDHSVIMWDIGGRKGTAIELQGHNDRVQALSYAQHTRQLISCGGDGGIVVWNMDVERQETPEWLDSDSCQKCDQPFFWNFKQMWDSKKIGLRQHHCRKCGKAVCGKCSSKRSSIPLMGFEFEVRVCDSCHEAITDEERAPTATFHDSKHNIVHVHFDATRGWLLTSGTDKVIKVRCHLIKKLSIFGLI

SEQ ID NO: 832444 - protein, 463 aa, Homo sapiens; identical to SEQ ID NO: 832441

SEQ ID NO: 832445 - protein, 418 aa, Homo sapiens
LVPEAGSAESFPREAARLCSPVSGVPLRPARVSVSTCVRAPAVSSARPRGAVGGGAPGAPPPPMAAEIQPKPLTRKPILLQRMEGSQEVVNMAVIVPKEEGVISVSEDRTVRVWLKRDSGQYWPSVYHAMPSPCSCMSFNPETRRLSIGLDNGTISEFILSEDYNKMTPVKNYQAHQSRVTMILFVLELEWVLSTGQDKQFAWHCSESGQRLGGYRTSAVASGLQFDVETRHVFIGDHSGQVTILKLEQENCTLVTTFRGHTGGVTALCWDPVQRVLFSGSSDHSVIMWDIGGRKGTAIELQGHNDRVQALSYAQHTRQLISCGGDGGIVVWNMDVERQETPEWLDSDSCQKCDQPFFWNFKQMWDSKKIGLRQHHCRKCGKAVCGKCSSKRSSIPLMGFEFEVRVCDSCHEAITDEE

SEQ ID NO: 832446 - protein, 471 aa, Homo sapiens
LVPEAGSAESFPREAARLCSPVSGVPLRPARVSVSTCVRAPAVSSARPRGAVGGGAPGAPPPPMAAEIQPKPLTRKPILLQRMEGSQEVVNMAVIVPKEEGVISVSEDRTVRVWLKRDSGQYWPSVYHAMPSPCSCMSFNPETRRLSIGLDNGTISEFILSEDYNKMTPVKNYQAHQSRVTMILFVLELEWVLSTGQDKQFAWHCSESGQRLGGYRTSAVASGLQFDVETRHVFIGDHSGQVTILKLEQENCTLVTTFRGHTGGVTALCWDPVQRVLFSGSSDHSVIMWDIGGRKGTAIELQGHNDRVQALSYAQHTRQLISCGGDGGIVVWNMDVERQETPEWLDSDSCQKCDQPFFWNFKQMWDSKKIGLRQHHCRKCGKAVCGKCSSKRSSIPLMGFEFEVRVCDSCHEAITDEERAPTATFHDSKHNIVHVHFDATRGWLLTSGTDKVIKVLSFCKRKSLYEMGTEL

SEQ ID NO: 832447 - protein, 1286 aa, Homo sapiens
SINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEELKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 832448 - protein, 143 aa, Homo sapiens [sequence omitted]

SEQ ID NO: 832449 - protein, 1245 aa, Homo sapiens
SINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEELKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 832450 - protein, 1245 aa, Homo sapiens; identical to SEQ ID NO: 832449

SEQ ID NO: 832451 - protein, 522 aa, Homo sapiens
IPIGTQGAEKSNSVMVNSFFQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEELKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 832452 - protein, 1245 aa, Homo sapiens; identical to SEQ ID NO: 832449

SEQ ID NO: 832453 - protein, 1245 aa, Homo sapiens; identical to SEQ ID NO: 832449

SEQ ID NO: 832454 - protein, 143 aa, Homo sapiens [sequence omitted]

SEQ ID NO: 832455 - protein, 468 aa, Homo sapiens
SINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIGQNSAPVCIEQLPCARHHLDVLSKNY

SEQ ID NO: 832456 - protein, 155 aa, Homo sapiens
SINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQ

SEQ ID NO: 832457 - protein, 143 aa, Homo sapiens [sequence omitted]

SEQ ID NO: 832458 - protein, 799 aa, Homo sapiens [sequence omitted]

SEQ ID NO: 832459 - protein, 1166 aa, Homo sapiens
SINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEELKLRQQLLSQNDKLLQSLRVELKAYEKLDEEHRRLRDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 832460 - protein, 1245 aa, Homo sapiens; identical to SEQ ID NO: 832449

SEQ ID NO: 832461 - protein, 143 aa, Homo sapiens [sequence omitted]

SEQ ID NO: 832462 - protein, 1010 aa, Homo sapiens
SINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEELKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQRSSWRPLAEKRWAIPRRV

SEQ ID NO: 832463 - protein, 176 aa, Homo sapiens [sequence omitted]

SEQ ID NO: 832464 - protein, 176 aa, Homo sapiens [sequence omitted]

SEQ ID NO: 832465 - protein, 176 aa, Homo sapiens [sequence omitted]

SEQ ID NO: 832466 - protein, 176 aa, Homo sapiens [sequence omitted]

SEQ ID NO: 832467 - protein, 282 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGGTTQTEKKKCVADSRRKTLLNNRGGRPQVVTGQGGENGRRGVTKEPGTGETRWPVTA

SEQ ID NO: 832468 - protein, 254 aa, Homo sapiens
MKASGTLREYKVVGRCLPTPKCHTPPLYRMRIFAPNHVVAKSRFWYFVSQLKKMKKSSGEIVYCGQVFEKAPPCGVGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGTLRYRGWCPQRINSLRRKRAPAEKKHKNKKKKKKKKKKPGPFFGGGEKAVL

SEQ ID NO: 832469 - protein, 321 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGENTHNRHGLLFNQHIMPRSNSILIKTPWKFTGASQFSYSPRGLHPHYYSGLESPEYRTHSQGRIIISLKASNCIPLIVLGTLGGLVLRLTPFNSAG

SEQ ID NO: 832470 - protein, 329 aa, Homo sapiens
GRVGRPTRRTHASRTRVPFAGGGRTRKEHAMKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGDPTPPPPTPPPPPTPPTHPPPPPTPRHPPPPPQAPPHPPPPPHHRPTAHTTHPHHPPPSPPPTPPPSPPTPHPP

SEQ ID NO: 832471 - protein, 208 aa, Homo sapiens
MLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPAAVLAACFLCTLQSSKGCYERPAQSAPGVQLSCHFFVLGGVFSANKQTLTSSCPGVGPPGAPTPELPLAWSVLSPAGSPGL

SEQ ID NO: 832472 - protein, 153 aa, Homo sapiens
GRLLLLLLEFKLLTMYGDVTGEYRGPWTHRRRLVHPVAYRDMGEIASFDKAKLKKTETQEKNTLPTKETIEQEKRSEISYDPGGFPTPVLFETPVVMWRKSHLKMDTSHKLHCEPGALAPMPPACGSLKGPPPNRTAKFSGLPRDIIENYLYE

SEQ ID NO: 832473 - protein, 255 aa, Homo sapiens
SARARNSCTTSGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSLRRQATSHASTTKEGPTTFPSRVAGPLRFRGWCPPKINNLRRKRAPGVSEPVVGVVWCWCGLGGGGGCGG

SEQ ID NO: 832474 - protein, 253 aa, Homo sapiens
SGGSCWARKAGKTFFSAIIAHARNPGDAWWRGSASPRHWPAAPRARVYCASGQSPPPPPAWPSGSCSSVASAAVGRRSEVRGCAPRPRLRRSARRMDPVPGTDSAPLAGLAWSSASAPPPRGFSAISCTVEGAPASFGKSFAQKSGYFLCLSSLGSLENPQENVVADIQIVVDKSPLPLGFSPVCDPMDSSFAHAASSAWGTFSLLFVAHSPSSVRCHLHPSLPLLFWAHNPSAALGDRVRLCLKKKRKENRP

SEQ ID NO: 832475 - protein, 408 aa, Homo sapiens
SGGSCWARKAGKTFFSAIIAHARNPGDAWWRGSASPRHWPAAPRARVYCASGQSPPPPPAWPSGSCSSVASAAVGRRSEVRGCAPRPRLRRSARRMDPVPGTDSAPLAGLAWSSASAPPPRGFSAISCTVEGAPASFGKSFAQKSGYFLCLSSLGSLENPQENVVADIQIVVDKSPLPLGFSPVCDPMDSKASVSKKKRMCVKLLPLGATDTAVFDVRLSGKTKTVPGYLRIGDMGGFAIWCKKAKAPRPVPKPRGLSRDMQGLSLDAASQPSKGGLLERTASRLGSRASTLRRNDSIYEASSLYGISAMDGVPFTLHPRFEGKSCSPLAFSAFGDLTIKSLADIEEEYNYGSWWRRRGWPAAPKFIVLTFEKRPNTPNGHTPQILGLTSVYQGNRGEKENTHRVDKM

SEQ ID NO: 832476 - protein, 368 aa, Homo sapiens
SGGSCWARKAGKTFFSAIIAHARNPGDAWWRGSASPRHWPAAPRARVYCASGQSPPPPPAWPSGSCSSVASAAVGRRSEVRGCAPRPRLRRSARRMDPVPGTDSAPLAGLAWSSASAPPPRGFSAISCTVEGAPASFGKSFAQKSGYFLCLSSLGSLENPQENVVADIQIVVDKSPLPLGFSPVCDPMDSKASVSKKKRMCVKLLPLGATDTAVFDVRLSGKTKTVPGYLRIGDMGGFAIWCKKAKAPRPVPKPRGLSRDMQGLSLDAASQPSKGGLLERTASRLGSRASTLRRNDSIYEASSLYGISAMDGVPFTLHPRFEGKSCSPLAFSAFGDLTIKSLADIEEEYNYGFVVEKTAAARLPPSVS

SEQ ID NO: 832477 - protein, 294 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKKKKKKKQKKKKKKKTKKKQQTKGGHGTKKYTAGGANR

SEQ ID NO: 832478 - protein, 399 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKKKKKKKQKKKKKKKTKKKKKKTRGERRHSETSAEERGICGRADVAGGAQGGGGRVKGAEGWRDMGGHGGRCKEGAPGHEGGGGEKETVGRSHGRRQPNRQRGTTTNRGRYHEAGAGHREGHKRAVHSRAGKHGTWTEKSTRV

SEQ ID NO: 832479 - protein, 327 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKKKKKKKPPGASLYSGGAEKKRGIKRAPWAPKGVFLVNPRFSCVTKVGETRGRGTPIRGRRRINIAENAAG

SEQ ID NO: 832480 - protein, 311 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKTKKKKNKKKKKKKKNKKKGGGGQKTNTPGGATKRETHTIILEKKRGATKGAAKK

SEQ ID NO: 832481 - protein, 284 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKKHKNKKKKKKKKKKPGPFFGGGEKAVL

SEQ ID NO: 832482 - protein, 316 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKKHKQRDNKKKKQNKKKKRGRKRTKRTRSRPEVAEDTREERERGGEKRGKQRGLGRESGR

SEQ ID NO: 832483 - protein, 321 aa, Homo sapiens; identical to SEQ ID NO: 832469

SEQ ID NO: 832484 - protein, 292 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPAAKNRTQTKTKTVWGPWPWEKFINHLWGRAPQGKTEDKGPQEQGRQGGVHNKSGDRGLTTERPGKGSR

SEQ ID NO: 832485 - protein, 250 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGEKKKQKQEQKQKTGAFFSGGGKSGF

SEQ ID NO: 832486 - protein, 321 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAVTKKKTKKIKKKKKKKKKNKKKKKKKKQKKRGGGPKNKYPRGGHQKRNTHHYIGEKEGRHKGSGKK

SEQ ID NO: 832487 - protein, 254 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGTLRYRGWCPQRINSLRRKRAPAEKKHKNKKKKKKKKKKPGPFFGGGEKAVL

SEQ ID NO: 832488 - protein, 280 aa, Homo sapiens
GRVGRPTRRTHASRTRVPFAGGGRTRKEHAMKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGEKKKQKQEQKQKTGAFFSGGGKSGF

SEQ ID NO: 832489 - protein, 292 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPAAKNRTQTKTKTVWGPWPREKFINHLWGRAPQGKTEDKGPQEQGRQGGVHNKSGDRGLTTERPGKGSR

SEQ ID NO: 832490 - protein, 299 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGDPTPPPPTPPPPPTPPTHPPPPPTPRHPPPPPQAPPHPPPPPHHRPTAHTTHPHHPPPSPPPTPPPSPPTPHPP

SEQ ID NO: 832491 - protein, 258 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPAAQKHSTTGHSPIGAIHYCRVTRDWNLATLMLVP

SEQ ID NO: 832492 - protein, 201 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKDEFRHDHDEL

SEQ ID NO: 832493 - protein, 189 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHCSNDHSSPLPPPVSLRLSSTQPRL

SEQ ID NO: 832494 - protein, 252 aa, Homo sapiens
MRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGTLRYRGWCPQRINSLRRKRAPAEKTKKKKNKKKKKKKKNKKKGGGGQKTNTPGGATKRETHTIILEKKRGATKGAAKK

SEQ ID NO: 832495 - protein, 141 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDS

SEQ ID NO: 832496 - protein, 218 aa, Homo sapiens
GRVGRPTRRTHASRTRVPFAGGGRTRKEHAMKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLRRARSPTSIFRFMERFGGDSRASKVAAGRHGSRQFPRTPRSSSRLPHRVLAPSGNKPRFNHQGGPNNLSF

SEQ ID NO: 832497 - protein, 274 aa, Homo sapiens
GGAQGSLINLIPPPPPRFPFAGGGRTRKEHAMKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGEKNNNKTTPPQNKHNTQE

SEQ ID NO: 832498 - protein, 254 aa, Homo sapiens
MYEAWWFERGEHAMKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGEKKESRRGREFSSSSR

SEQ ID NO: 832499 - protein, 281 aa, Homo sapiens
MEHAMKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGETKNKHKQNKKLRGLPMGGGGKRGSGRGLGAKRVSWTKFSGPKGEIRRAPYW

SEQ ID NO: 832500 - protein, 112 aa, Homo sapiens
MDSRERAPTTYVTGEYRGPWTHRRRLVHPVALPEEQLGLPGNRRARSPTSIFRFMERFGGDSRASKVAAGRHGSRQFPRTPRSSSRLPHRVLAPSGNKPRFNHQGGPNNLSF

SEQ ID NO: 832501 - protein, 75 aa, Homo sapiens
RPPTTTTARIQASNDVRGERFGGDSRASKVAAGRHGSRQFPRTPRSSSRLPHRVLAPSGNKPRFNHQGGPNNLSF

SEQ ID NO: 832502 - protein, 153 aa, Homo sapiens
TSAAEYDSTSQRQDLSHCCNSLSESIRPCTMTSVRESLACAMDSRERAPTTYVTGEYRGPWTHRRRLVHPVALPEEQLGLPGNRRAPSPTSIFRFMERFGGDSRASKVAAGRHGSRQFPRTPRSSSRLPHRVLAPSGNKPRFNHQGGPNNLSF

SEQ ID NO: 832503 - protein, 181 aa, Homo sapiens
MAKLLVLRPQSVHFHVITSQFHIFVRYLLISSPILVTRSCELEDKYITRKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHISKIKSPHNSQDPVDHRS

SEQ ID NO: 832504 - protein, 368 aa, Homo sapiens; identical to SEQ ID NO: 832476

SEQ ID NO: 832505 - protein, 233 aa, Homo sapiens
SGGSCWARKAGKTFFSAIIAHARNPGDAWWRGSASPRHWPAAPRARVYCASGQSPPPPPAWPSGSCSSVASAAVGRRSEVRGCAPRPRLRRSARRMDPVPGTDSAPLAGLAWSSASAPPPRGFSAISCTVEGAPASFGKSFAQKSGYFLCLSSLGSLENPQENVVADIQIVVDKSPLPLGFSPVCDPMDSKASVSKKKRMCVKLLPLGATDTAVFDVRLSGKTKTVPGYLRIG

SEQ ID NO: 832506 - protein, 311 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKKKKKKKQKKKKKKKTKKKGGGAKKQIPQGGPPKEKHTPLYWRKRGAPQRERQKR

SEQ ID NO: 832507 - protein, 243 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGEKNNNKTTPPQNKHNTQE

SEQ ID NO: 832508 - protein, 379 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKKKKKKKTKKKGGGGEKKFPGGGPNFAGPPFFFVTTGVPPIGGGGIYKAQGQRARGVNTPVVDGQTWLRLDLSGEGPLTCGAVALPRGRTSWGFNARGIYNCGGTVAPPHLLALEMCHGFSDI

SEQ ID NO: 832509 - protein, 271 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKKESRRGREFSSSSR

SEQ ID NO: 832510 - protein, 241 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGAKLRNAPVKNHRYTQY

SEQ ID NO: 832511 - protein, 276 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAVKFFFFFECRLAAFFVVVWAR

SEQ ID NO: 832512 - protein, 284 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGPLRYRGWCPQRINNLRRKRAPAEKKKKKNSKKTKKQQQNNTTTKQTQHTRK

SEQ ID NO: 832513 - protein, 276 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGEKKKKKFRGHPMSEFANKRGPDIGPWVIAGTVTKFLGPTGVNLADPQLERR

SEQ ID NO: 832514 - protein, 286 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHELQDQVPACPTGSWRRQATSHASTTKEGPTTFSSRVAGTLRYRGWCPQRINSLRRKRAPAEKKHKQRDNKKKKQNKKKKRGRKRTKRTRSRPEVAEDTREERERGGEKRGKQRGLGRESGR

SEQ ID NO: 832515 - protein, 241 aa, Homo sapiens; identical to SEQ ID NO: 832510

SEQ ID NO: 832516 - protein, 245 aa, Homo sapiens
MKASGTLREYKVVGRCLPTPKCHTPPLYRMRIFAPNHVVAKSRFWYFVSQLKKMKKSSGEIVYCGQVFEKAPPCGLGKNFGDLGRALLTPGSGHPQHMLPGNTGDLGPTAGGLFTQLLYPRNNWGCPATVGPRGPLPFSDSWNGLEEIRGPAKLPPAGMVQGSFHELQDQVPACPTGSWRRQATSHASTTKEGPTTFPSRVAGPLRFRGWCPPKINNLRRKRAPGVSGTAPIQLLQAYSNAAPIR

SEQ ID NO: 832517 - protein, 213 aa, Homo sapiens
ILIKCLKKEPRKGVFVFNKLYKITERGEHAMKASGTLREYKVVGRCLPTPKCHTPPLYRMRIFAPNHVVAKSRFWYFVSQLKKMKKSSGEIVYCGQVFEKAPPCGLGKNFGDLGRALWTPGSGHPQHMLPGNTGDLGPTAGGLFTQLLYPRNHWGCPATVGPGGPLPFSDSLNGLEEIRGPAKLPPAGIVQGSFHISKIKSPHNSQDPVDHRS

SEQ ID NO: 832518 - protein, 134 aa, Homo sapiens
GGAQGSLIILIPPPPPRFPFAGGGRTRKEHAMKASGTLREYKVVGRCLPTPKCHTPPLYRMRIFAPNHVVAKSRFWYFVSQLKKMKKSSGEIVYCGQVWRGRGYVGSGVDLRLLGHRASQELIRHRTGAVAQRL

SEQ ID NO: 832519 - protein, 134 aa, Homo sapiens; identical to SEQ ID NO: 832518

SEQ ID NO: 832520 - protein, 176 aa, Homo sapiens [sequence omitted]

SEQ ID NO: 832521 - protein, 176 aa, Homo sapiens [sequence omitted]

SEQ ID NO: 832522 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 832523 - protein, 442 aa, Homo sapiens; identical to SEQ ID NO: 832522

SEQ ID NO: 832524 - protein, 442 aa, Homo sapiens; identical to SEQ ID NO: 832522

SEQ ID NO: 832525 - protein, 442 aa, Homo sapiens; identical to SEQ ID NO: 832522

SEQ ID NO: 832526 - protein, 442 aa, Homo sapiens; identical to SEQ ID NO: 832522

SEQ ID NO: 832527 - protein, 409 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKVRDYPKIKSSL

SEQ ID NO: 832528 - protein, 336 aa, Homo sapiens [sequence omitted]

SEQ ID NO: 832529 - protein, 154 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGKPGLEQSN

SEQ ID NO: 832530 - protein, 532 aa, Homo sapiens
MNKSTCLMAAETPSKRWRLHCLAFSQRFVRAGPACSSREACSSPRAGWNPAGFRLPGRWSPFVALHLVCQIREALKLRSGHRTPSGAGSSMQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 832531 - protein, 442 aa, Homo sapiens; identical to SEQ ID NO: 832522

SEQ ID NO: 832532 - protein, 436 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKAGPHVGNKLVMLFSVNIECDGTVNQNPTMWPERKSNNN

SEQ ID NO: 832533 - protein, 442 aa, Homo sapiens; identical to SEQ ID NO: 832522

SEQ ID NO: 832534 - protein, 169 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDLPF

SEQ ID NO: 832535 - protein, 225 aa, Homo sapiens
ETQEEMTEPVWVPARSRSPGHTLRLDAAATAASLSPRGCRLRTPSSDMSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNHCR

SEQ ID NO: 832536 - protein, 143 aa, Homo sapiens
ETQEEMTEPVWVPARSRSPGHTLRLDAAATAASLSPRGCRLRTPSSDMSPSGRLCLLTIVGLILPTRGQTLKDTTSSSSADSTIMDIQVPTRAPDAVYTELQPTSPTPTWPADGAYITAYGVTHFLMNMLAVSSFFCLHTAPQ

SEQ ID NO: 832537 - protein, 142 aa, Homo sapiens
ETQEEMTEPVWVPARSRSPGHTLRLDAAATAASLSPRGCRLRTPSSDMSPSGRLCLLTIVGLILPTRGQTLKDTTSSSSADSTIMDIQVPTRAPGEERDTSIKILSLQITTATKIPNLDQTREFMDLCNEKVQEESPLMGPR

SEQ ID NO: 832538 - protein, 245 aa, Homo sapiens
ETQEEMTEPVWVPARSRSPGHTLRLDAAATAASLSPRGCRLRTPSSDVSPSRAPPPSAAPLPTGRAQMSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNHCR

SEQ ID NO: 832539 - protein, 225 aa, Homo sapiens; identical to SEQ ID NO: 832535

SEQ ID NO: 832540 - protein, 140 aa, Homo sapiens
MSPSGRLCLLTIVGLILPTRGQTLKDTTSSSSADSTIMDIQVPTRAPVTDPETHKSTKAAHPTDDTTTLSERPSPSTDVQTDPQTLKPSGFHEDDPFFYDEHTLRKRGLLVAAVLFITGIIILTSGKCRQLSRLCRNHCR

SEQ ID NO: 832541 - protein, 194 aa, Homo sapiens
ETQEEMTEPVWVPARSRSPGHTLRLDAAATAASLSPRGCRLRTPSSDMSPSGRLCLLTIVGLILPTRGQTLKDTTSSSSADSTIMDIQVPTRAPDAVYTELQPTSPTPTWPADAHPTDDTTTLSERPSPSTDVQTDPQTLKPSGFHEDDPFFYDEHTLRKRGLLVAAVLFITGIIILTSGKCRQLSRLCRNHCR

SEQ ID NO: 832542 - protein, 225 aa, Homo sapiens; identical to SEQ ID NO: 832535

SEQ ID NO: 832543 - protein, 225 aa, Homo sapiens; identical to SEQ ID NO: 832535

SEQ ID NO: 832544 - protein, 159 aa, Homo sapiens
ETQEEMTEPVWVPARSRSPGHTLRLDAAATAASLSPRGCRLRTPSSDMSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPS

SEQ ID NO: 832545 - protein, 149 aa, Homo sapiens
ETQEEMTEPVWVPARSRSPGHTLRLDAAATAASLSPRGCRLRTPSSDMSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAGIAWD

SEQ ID NO: 832546 - protein, 225 aa, Homo sapiens; identical to SEQ ID NO: 832535

SEQ ID NO: 832547 - protein, 115 aa, Homo sapiens [sequence omitted]

SEQ ID NO: 832548 - protein, 178 aa, Homo sapiens [sequence omitted]

SEQ ID NO: 832549 - protein, 269 aa, Homo sapiens
ETQEEMTEPVWVPARSRSPGHTLRLDAAATAASLSPRGCRLRTPSSDMSPSGRLCLLTIVGLILPTRGWNRLWGRRQEQGAQEGGCWDVQAGGYRGRTRMGAVELSSTDHNGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNHCR

SEQ ID NO: 832550 - protein, 170 aa, Homo sapiens
ETQEEMTEPVWVPARSRSPGHTLRLDAAATAASLSPRGCRLRTPSSDMSPSGRLCLLTIVGLILPTRGQTLKDTTSSSSADSTIMDIQVPTRAPGEERDTSIKILSLQITTATKIPNLDQTREFMDLCNEKVQMQSTQNSSPPLQPQPGLLMKHHNPRPRPSNWKERMGL

SEQ ID NO: 832551 - protein, 225 aa, Homo sapiens; identical to SEQ ID NO: 832535

SEQ ID NO: 832552 - protein, 225 aa, Homo sapiens; identical to SEQ ID NO: 832535

SEQ ID NO: 832553 - protein, 185 aa, Homo sapiens
ETQEEMTEPVWVPARSRSPGHTLRLDAAATAASLSPRGCRLRTPSSDMSPSGRLCLLTIVGLILPTRGQTLKDTTSSSSADSTIMDIQVPTRAPDAVYTELQPTSPTPTWPADETPQPQTQTQQLEGTDGPLVTDPETHKSTKADEHTLRKRGLLVAAVLFITGIIILTSGKCRQLSRLCRNHCR

SEQ ID NO: 832554 - protein, 104 aa, Homo sapiens
MSPSGRLCLLTIVGLILPTRGQTLKDTTSSSSADSTIMDIQVPTRAPDAVYTELQPTSPTPTWPADAGQYYKSEQMQPFSAFTDDMSPSPASRGRGGRLKVTLR

SEQ ID NO: 832555 - protein, 333 aa, Homo sapiens
KDKRESISLDSWLNLFNNNNILKKKKKGGRRAMLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 832556 - protein, 301 aa, Homo sapiens
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 832557 - protein, 193 aa, Homo sapiens
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLLDGFIARNWANQRSALGSALDPLADKILISILYVSLTYADLIPGA

SEQ ID NO: 832558 - protein, 301 aa, Homo sapiens; identical to SEQ ID NO: 832556

SEQ ID NO: 832559 - protein, 301 aa, Homo sapiens; identical to SEQ ID NO: 832556

SEQ ID NO: 832560 - protein, 190 aa, Homo sapiens
MLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 832561 - protein, 352 aa, Homo sapiens
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLKLLAGHSVGMNFRVTSGVHLTVSVVKLEILSSPFYLHPLLEGPPLHIALIKYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 832562 - protein, 190 aa, Homo sapiens; identical to SEQ ID NO: 832560

SEQ ID NO: 832563 - protein, 190 aa, Homo sapiens; identical to SEQ ID NO: 832560

SEQ ID NO: 832564 - protein, 190 aa, Homo sapiens; identical to SEQ ID NO: 832560

SEQ ID NO: 832565 - protein, 105 aa, Homo sapiens [sequence omitted]

SEQ ID NO: 832566 - protein, 193 aa, Homo sapiens; identical to SEQ ID NO: 832557

SEQ ID NO: 832567 - protein, 301 aa, Homo sapiens; identical to SEQ ID NO: 832556

SEQ ID NO: 832568 - protein, 301 aa, Homo sapiens; identical to SEQ ID NO: 832556

SEQ ID NO: 832569 - protein, 333 aa, Homo sapiens; identical to SEQ ID NO: 832555

SEQ ID NO: 832570 - protein, 301 aa, Homo sapiens; identical to SEQ ID NO: 832556

SEQ ID NO: 832571 - protein, 301 aa, Homo sapiens; identical to SEQ ID NO: 832556

SEQ ID NO: 832572 - protein, 301 aa, Homo sapiens; identical to SEQ ID NO: 832556

SEQ ID NO: 832573 - protein, 301 aa, Homo sapiens; identical to SEQ ID NO: 832556

SEQ ID NO: 832574 - protein, 301 aa, Homo sapiens; identical to SEQ ID NO: 832556

SEQ ID NO: 832575 - protein, 190 aa, Homo sapiens; identical to SEQ ID NO: 832560

SEQ ID NO: 832576 - protein, 282 aa, Homo sapiens
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 832577 - protein, 153 aa, Homo sapiens
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLFHLLT

SEQ ID NO: 832578 - protein, 244 aa, Homo sapiens
VPAASQNPLSLMRAPPLCQGRREARRRRCRKSVAKASALGGFLPPYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 832579 - protein, 143 aa, Homo sapiens
PGCRIQHELDGFIARNWANQRSALGSALDPLADKILISILYVSLTYADLIPVPLTYMIISRDVMLIAAVFYVRYRTLPTPRTLAKYFNPCYATARLASLAAPVFNYADSIYLQILWCFTAFTTAASAYSYYHYGRKTVQVIKD

SEQ ID NO: 832580 - protein, 110 aa, Homo sapiens
MAAPMPVAATGAADDDEAETSCPSCAQTLHELAMSSSTLAINDMIGDGRALVDRVMAVAILTGYSICVMQADLFRGWNALETLLQAMMGPVAGTGPSLIFSDILHYVFRV

SEQ ID NO: 832581 - protein, 298 aa, Homo sapiens
SGSARKTHALAACAALSAAPARGGPVGLSAGFEISPGACAAAAMAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFVSSAVTGDPAGSRVRNVTNIPYVTWACIWVGASMV

SEQ ID NO: 832582 - protein, 392 aa, Homo sapiens
SGSARKTHALAACAALSAAPARGGPVGLSAGFEISPGACAAAAMAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFGLSLVQRLRPDFKRKYSSMFEDDTVTEYIYHCNVQTPSGETAFKNMTIPYGWAKRPMLQRIGKMHPDIPVSVIFGARSCIDGNSGTSIQSLRPHSYVKTIAILGAGHYVYADQPEEFNQKVKEICDTVD

SEQ ID NO: 832583 - protein, 317 aa, Homo sapiens
SGSARKTHALAACAALSAAPARGGPVGLSAGFEISPGACAAAAMAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFGLSLVQRLRPDFKRKYSSMFEDDTVTEYIYHCNVQTPSGETAFKNMTIPYGWAQ

SEQ ID NO: 832584 - protein, 365 aa, Homo sapiens
SGSARKTHALAACAALSAAPARGGPVGLSAGFEISPGACAAAAMAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFGLSLVQRLRPDFKRKYSSMFEDDTVTEYIYHCNVQTPSSDLWRPILHRWQFWHQHPVLTTTFICEDNSYSWGRTLCICRSTRRIQPESKGDLRHCGLNTLKL

SEQ ID NO: 832585 - protein, 308 aa, Homo sapiens
MLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFGLSLVQRLRPDFKRKYSSMFEDDTVTEYIYHCNVQTPSGETAFKNMTIPYGWAKRPMLQRIGKMHPDIPVSVIFGARSCIDGNSGTSIQSLRPHSYVKTIAILGAGHYVYADQPEEFNQKVKEICDTVD

SEQ ID NO: 832586 - protein, 392 aa, Homo sapiens; identical to SEQ ID NO: 832582

SEQ ID NO: 832587 - protein, 212 aa, Homo sapiens
SGSARKTHALAACAALSAAPARGGPVGLSAGFEISPGACAAAAMAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSR

SEQ ID NO: 832588 - protein, 365 aa, Homo sapiens; identical to SEQ ID NO: 832584

SEQ ID NO: 832589 - protein, 589 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832590 - protein, 307 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEEEWVQSESEGGLVQKTVCSTVDWGGGGSRSVGSGGMFALRGGPTFVALVLESRG

SEQ ID NO: 832591 - protein, 177 aa, Homo sapiens
LTAAVLSVDVYTILAAASNVLKIRVAKYGPAFYHATIIPKVLAMSGDPNYLHRMTTLFCINVLSEVCGQDITTKHMLPTVLRMAGDPVANVRFNVASVRTDATSTTDRHCARYQRSIGRRYGWRMAQNRRSHSSPAQQIRHPADALCMQALDVYPLRRIGHAGGFRIFAAGSCGPVY

SEQ ID NO: 832592 - protein, 589 aa, Homo sapiens; identical to SEQ ID NO: 832589

SEQ ID NO: 832593 - protein, 589 aa, Homo sapiens; identical to SEQ ID NO: 832589

SEQ ID NO: 832594 - protein, 589 aa, Homo sapiens; identical to SEQ ID NO: 832589

SEQ ID NO: 832595 - protein, 589 aa, Homo sapiens; identical to SEQ ID NO: 832589

SEQ ID NO: 832596 - protein, 589 aa, Homo sapiens; identical to SEQ ID NO: 832589

SEQ ID NO: 832597 - protein, 587 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTGKT

SEQ ID NO: 832598 - protein, 109 aa, Homo sapiens
MRTFSFASTASRSCPPSPWPLGLKGPEVSFCLSLQIPSMMKMRSSWPWQNSWEPSLPWWEAQSTCTACCHRWSRWPQWRRQWCGTRQWSPYGPSHTSTRPLTWRRTLCR

SEQ ID NO: 832599 - protein, 399 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDSPCRVKSSPS

SEQ ID NO: 832600 - protein, 521 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVFAIGRGTEPEDFGNWRVGLPNSQGWLSGTYCRGYLGKVWAGGNPQVRWVGRPLFSNTRPRGQHSGT

SEQ ID NO: 832601 - protein, 629 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQVSFASWPSALPSFWWFLPMKENPRAQQGLCCPPTVPLLSLDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832602 - protein, 592 aa, Homo sapiens
MKKGGESFTVCPAIRAAGFGSHTPSVLALLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832603 - protein, 478 aa, Homo sapiens
MAAADGDDSLYPIAVLIDELRNEDVQLRLNSIKKLSTIALALGVERTPSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832604 - protein, 361 aa, Homo sapiens
ASTDQVCLGDLRPHCFLELCELVSHHVADAPGLVFSGLAQSGHHQGLQILLGQKLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832605 - protein, 281 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEERNRMRAVRGSQPNTRRRETTPGGQRNG

SEQ ID NO: 832606 - protein, 307 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEEYMGAVRVRRWAGPEDCLLDCRLGRGGLQVSGLRGDVCPPRGAHVVALVLESRG

SEQ ID NO: 832607 - protein, 249 aa, Homo sapiens
NKSGIGKTTKPRIPPAGQDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832608 - protein, 351 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRCWRGSVVNIAKLGPRGPGGPGNGTLAKQMRKVWERPNTGVCTRPRDPERHEGREITKEKPEPGHSNGNRTVAHHVYATPTREKERWTHTRMNKITHKKPTSKETRHTKLGRIQQMHMHRDDNSNNSREIE

SEQ ID NO: 832609 - protein, 132 aa, Homo sapiens
MAAADGDDSLYPIAVLIDELRNEDVQRRGFTMLARLGRELLTSSDPPASASQSVGITGVTTAPSPDEHSWLWDEVTQGSEPAGVGLRTVRTASPPPTCCVTLCKLLHRFGSLCSIKYGLIVVLVLLEGLVRD

SEQ ID NO: 832610 - protein, 216 aa, Homo sapiens
QLNEDIIVIILLAHFPDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSESAHPSSVRIRYEYLS

SEQ ID NO: 832611 - protein, 589 aa, Homo sapiens; identical to SEQ ID NO: 832589

SEQ ID NO: 832612 - protein, 310 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAESSVKTSQLTVGRM

SEQ ID NO: 832613 - protein, 589 aa, Homo sapiens; identical to SEQ ID NO: 832589

SEQ ID NO: 832614 - protein, 589 aa, Homo sapiens; identical to SEQ ID NO: 832589

SEQ ID NO: 832615 - protein, 571 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVVSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832616 - protein, 569 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSESAHPSSVRIR

SEQ ID NO: 832617 - protein, 554 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCWGRTSPPPHCLPHRFLPHWLGGTPVCPFPFQLGQSPAKKKGG

SEQ ID NO: 832618 - protein, 496 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVCAIREAAIKKTASRMGGRGKMRGKVQPSLAMLPMHGERLTS

SEQ ID NO: 832619 - protein, 573 aa, Homo sapiens
NRVVLESATELRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832620 - protein, 500 aa, Homo sapiens
MRNLRSVSHTLFSFKPHADLWGRYCYYQLRFIGLGRQRGGHHLPKVIQLKPGPTQLQSLCLLLSAILPAASGSPSPTPRYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832621 - protein, 319 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEEGEKKRGARKGAQRHNPKTGAGTRRRAAPSWRRGAGRAPGKGTTPRETAAPQSAATNNALVARNNT

SEQ ID NO: 832622 - protein, 263 aa, Homo sapiens
NRLGTRLGLNRPQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832623 - protein, 144 aa, Homo sapiens
LTAAVLSVDVYTILAAASNVLKIRVAKYGPAFYHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 832624 - protein, 168 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQ

SEQ ID NO: 832625 - protein, 1880 aa, Homo sapiens [sequence omitted]

SEQ ID NO: 832626 - protein, 1853 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCDLMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLYFEELYADDPKKYQSYRISLYKRMIDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 832627 - protein, 1642 aa, Homo sapiens
MRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCDLMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLYFEELYADDPKKYQSYRISLYKRMIDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 832628 - protein, 1830 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCDLMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLYFEELYADDPKKYQSYRISLYKRMIDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQ

SEQ ID NO: 832629 - protein, 217 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMEVRQRVFGFLPIFS

SEQ ID NO: 832630 - protein, 1855 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCDLMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 832631 - protein, 1828 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCDLMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 832632 - protein, 1855 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCDLMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLYFEELYADDPKKYQSYRISLYKRMIDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 832633 - protein, 1450 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCDLMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVSVLCACCVSVTVR

SEQ ID NO: 832634 - protein, 139 aa, Homo sapiens
RPPRRGAASAQAGGRRRAGPAMAASELYTKVRHPAAGVEDWGCAALAASCQAGEGAGAPGPGEPHQRHPLQRLRTLGPTSRSPAAAPSSFGRDGEGGGRWPASGVSQAPAALLELGAERASEWKGGPCGFSRAGVPPLL

SEQ ID NO: 832635 - protein, 91 aa, Homo sapiens
MGLEDEQKMLTESGDPEEEEEEEEELVDPLTTVREQCEQLEKCVKARERLELCDERDSSRSHTEEDCTEELFDFLHARDHCVAHKLFNNLK

SEQ ID NO: 832636 - protein, 91 aa, Homo sapiens; identical to SEQ ID NO: 832635

SEQ ID NO: 832637 - protein, 91 aa, Homo sapiens; identical to SEQ ID NO: 832635

SEQ ID NO: 832638 - protein, 415 aa, Homo sapiens
ARGAALPALEPRCRSRPPPEEEVEGAGGARRGGGGGGKMADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 832639 - protein, 91 aa, Homo sapiens; identical to SEQ ID NO: 832635

SEQ ID NO: 832640 - protein, 91 aa, Homo sapiens
MGLEDEQKMLTESGDPEEEEEEEEELVDPLTTVREQCEQLEKCVKARERLELCDERVSSRSHTEEDCTEELFDFLHARDHCVAHKLFNNLK

SEQ ID NO: 832641 - protein, 91 aa, Homo sapiens; identical to SEQ ID NO: 832640

SEQ ID NO: 832642 - protein, 91 aa, Homo sapiens; identical to SEQ ID NO: 832635

SEQ ID NO: 832643 - protein, 415 aa, Homo sapiens; identical to SEQ ID NO: 832638

SEQ ID NO: 832644 - protein, 102 aa, Homo sapiens
MGLEDEQKMLTESGDPEEEEEEEEELVIGLRLSVHTGNLGRQECETFPYYLASELNGRPHSAISGGSVALPAGLLHGSPNNSERAMRAVGEMCKGPGAARAL

SEQ ID NO: 832645 - protein, 102 aa, Homo sapiens; identical to SEQ ID NO: 832644

SEQ ID NO: 832646 - protein, 33 aa, Homo sapiens
MICKKNNNKTERHEKGAQTDAKTTTRRHNTTKG

SEQ ID NO: 832647 - protein, 102 aa, Homo sapiens; identical to SEQ ID NO: 832644

SEQ ID NO: 832648 - protein, 102 aa, Homo sapiens
IRYEVSCTMCRRLLAQGQRSPPQALSSKSRARLLMAMGSSALVYPTGSVKQQKGHAPATGQLVPNSARAGLGAAVAARVESRTVARHGTGGRAKDAYRIRRS

SEQ ID NO: 832649 - protein, 91 aa, Homo sapiens; identical to SEQ ID NO: 832635

SEQ ID NO: 832650 - protein, 91 aa, Homo sapiens; identical to SEQ ID NO: 832640

SEQ ID NO: 832651 - protein, 91 aa, Homo sapiens; identical to SEQ ID NO: 832635

SEQ ID NO: 832652 - protein, 91 aa, Homo sapiens; identical to SEQ ID NO: 832635

SEQ ID NO: 832653 - protein, 91 aa, Homo sapiens; identical to SEQ ID NO: 832635

SEQ ID NO: 832654 - protein, 91 aa, Homo sapiens; identical to SEQ ID NO: 832640

SEQ ID NO: 832655 - protein, 119 aa, Homo sapiens
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQLRSFALPL

SEQ ID NO: 832656 - protein, 227 aa, Homo sapiens
MARTKQTARKSTGGKAPRKQLATKAARKSAPSTGGVKKPHRYRPGTVALREIRRYQKSTELLIRKLPFQRLVREIAQDYNCAESHSHNSLRNDFLTCAQREPVHLGLQVRLQAQQASNLGGFRVDDSSSHEIRRIRINFFKKCRTKSYDLGFGDFCVHWVLCFEDVLHFLLLNCFATLKEILRSHFCRLEEFVESDGQLHRHVLEGAPIPELNVEDAPPEVDTLYVP

SEQ ID NO: 832657 - protein, 136 aa, Homo sapiens; identical to SEQ ID NO: 778873

SEQ ID NO: 832658 - protein, 136 aa, Homo sapiens; identical to SEQ ID NO: 778873

SEQ ID NO: 832659 - protein, 136 aa, Homo sapiens; identical to SEQ ID NO: 778873

SEQ ID NO: 832660 - protein, 136 aa, Homo sapiens; identical to SEQ ID NO: 778873

SEQ ID NO: 832661 - protein, 136 aa, Homo sapiens; identical to SEQ ID NO: 778873

SEQ ID NO: 832662 - protein, 136 aa, Homo sapiens; identical to SEQ ID NO: 778873

SEQ ID NO: 832663 - protein, 136 aa, Homo sapiens; identical to SEQ ID NO: 778873

SEQ ID NO: 832664 - protein, 136 aa, Homo sapiens; identical to SEQ ID NO: 778873

SEQ ID NO: 832665 - protein, 136 aa, Homo sapiens; identical to SEQ ID NO: 778873

SEQ ID NO: 832666 - protein, 69 aa, Homo sapiens
VPPSFRSFNEQGMDEELERDEKVFLLGEEVAQYDGAYKVSRGLWKKYGFQYVFVAFLSYSRFHPFTILF

SEQ ID NO: 832667 - protein, 136 aa, Homo sapiens; identical to SEQ ID NO: 778873

SEQ ID NO: 832668 - protein, 136 aa, Homo sapiens; identical to SEQ ID NO: 778873

SEQ ID NO: 832669 - protein, 136 aa, Homo sapiens; identical to SEQ ID NO: 778873

SEQ ID NO: 832670 - protein, 136 aa, Homo sapiens; identical to SEQ ID NO: 778873

SEQ ID NO: 832671 - protein, 136 aa, Homo sapiens; identical to SEQ ID NO: 778873

SEQ ID NO: 832672 - protein, 701 aa, Homo sapiens
PASGRAPQPGRCTCQGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSSTRNYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 832673 - protein, 727 aa, Homo sapiens
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSSTRNYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 832674 - protein, 674 aa, Homo sapiens
RHSSRKATDTRLRGSGRDDLGTAVTPRPRPSPFPSLGKGRQVPGSLLGPGEGESAPQTTGASCLSPSINSPQCPGWARRGLRLPGGHTCLPFTAGRPGGATTTPAPPRLLRDGPASRGTDEDPDPGGARHSLQGPWLTLFPSPFRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSSTRNYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 832675 - protein, 380 aa, Homo sapiens
MAWNYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 832676 - protein, 727 aa, Homo sapiens; identical to SEQ ID NO: 832673

SEQ ID NO: 832677 - protein, 727 aa, Homo sapiens; identical to SEQ ID NO: 832673

SEQ ID NO: 832678 - protein, 100 aa, Homo sapiens
TDVHKMSGAATDTRVRCVHIWMWHTQESTHVSLLPWDHGTRKLEKLWAWNFPKKPLITRTKHNQGYTQACTGFLPSDGLSQPPTGLATLLSSSTDVCSSS

SEQ ID NO: 832679 - protein, 466 aa, Homo sapiens
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSSTRNYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTPAWVTARLGLKKK

SEQ ID NO: 832680 - protein, 204 aa, Homo sapiens
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRSVSPSA

SEQ ID NO: 832681 - protein, 64 aa, Homo sapiens
MVTLLSNLGSQWSLWFGSSVLSVVEMAELVFDLLVIMFLMLLRRFRSRYWSPGRGGRGAQEVAS

SEQ ID NO: 832682 - protein, 154 aa, Homo sapiens
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALLIRVSKRFLTEEGSLEGSFLGKKEPAIPTGGPFPPLGVGPPGTETGT

SEQ ID NO: 832683 - protein, 380 aa, Homo sapiens; identical to SEQ ID NO: 832675

SEQ ID NO: 832684 - protein, 318 aa, Homo sapiens
MVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 832685 - protein, 281 aa, Homo sapiens
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTALARLKDVQGFLSEPPKLPLMCGGEARWVRAQEVAPRTVADEAAQKCLGSSPVPLGTASEHSGFPTQLRLSLFFPWISQAKLGALTRNFPKKPLITRTKHNQGYTQACTGFLPSDGLSQPPTGLATLLSSSTDVCSSS

SEQ ID NO: 832686 - protein, 522 aa, Homo sapiens
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSSTRNYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGETPGSPHPAP

SEQ ID NO: 832687 - protein, 238 aa, Homo sapiens
PASGRAPQPGRCTCQVRGRRGLAARFNWKGTSPSPAATWEWEAGGSPDLLEPCSPGAETESGHSSRNYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGETPGSPHPAP

SEQ ID NO: 832688 - protein, 103 aa, Homo sapiens
TQKPPLLLRQFPFPDSRGLGLEQTRVSKGRPRAPLASYPCPHRAMPRHLCPVSFIPLHVCLRYFLSLKVSPTICQRTPMHPLEPCSDTITFVNASATSCLPQN

SEQ ID NO: 832689 - protein, 375 aa, Homo sapiens [sequence omitted]

SEQ ID NO: 832690 - protein, 133 aa, Homo sapiens
CGACLGGLKGSGWSTEVSQPLSFGQVMPQPQPDFLLLLVELFPNGQSVGEKIFKTAGFVKPFTEAQLLCTQAGGQLASPRSAAENAALQQLVVAKNEAAFLSMTDSKTEGKFTYPTGESLVYSNWAPGEPNDD

SEQ ID NO: 832691 - protein, 612 aa, Homo sapiens
MASPSPPPESKEEWDYLDPAQRSLYKDVMMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQMIHAEVKTQETHECDACGEAFNCRISLIQHQKLHTAWMQ

SEQ ID NO: 832692 - protein, 626 aa, Homo sapiens
MASPSPPPESKGLLTFEDVAVFFTQEEWDYLDPAQRSLYKDVMMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQMIHAEVKTQETHECDACGEAFNCRISLIQHQKLHTAWMQ

SEQ ID NO: 832693 - protein, 531 aa, Homo sapiens
MGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQMIHAEVKTQETHECDACGEAFNCRISLIQHQKLHTAWMQ

SEQ ID NO: 832694 - protein, 584 aa, Homo sapiens
MMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQMIHAEVKTQETHECDACGEAFNCRISLIQHQKLHTAWMQ

SEQ ID NO: 832695 - protein, 531 aa, Homo sapiens; identical to SEQ ID NO: 832693

SEQ ID NO: 832696 - protein, 151 aa, Homo sapiens
SYVDSEGSPVGVVQLTFLRLLQRPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQGRNGIVWGVCRAASRRWLEY

SEQ ID NO: 832697 - protein, 1620 aa, Homo sapiens
PVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 832698 - protein, 260 aa, Homo sapiens
PVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 832699 - protein, 103 aa, Homo sapiens
ERESRERERERERESARYRDCPPGSSTPLEAMKGPREEIVYLPCIYRNTGTEAPDYLATVDVDPKSPQYCQVIEPKDIHAKCELAFLHTSHCLASGAFRFISW

SEQ ID NO: 832700 - protein, 235 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEVTYALWPSPPSSLVSSST

SEQ ID NO: 832701 - protein, 393 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAH

SEQ ID NO: 832702 - protein, 375 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAH

SEQ ID NO: 832703 - protein, 309 aa, Homo sapiens
MRLVARGPRYVEVEASESVTRPRGMIAGVYELVAVLFIHHIKKRPGINRCVLSIIHDVTTQWVITGCMLGGSPCRSYDIYMIVAWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAH

SEQ ID NO: 832704 - protein, 393 aa, Homo sapiens; identical to SEQ ID NO: 832701

SEQ ID NO: 832705 - protein, 151 aa, Homo sapiens
RIPTVRRRGDVEALPIQAELDHLRASSHPFSLDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAH

SEQ ID NO: 832706 - protein, 375 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKRLYITTSLYSAWDKQFYPDLIREGSVMLQVDVDTVKGGLKLNPNFLVDFGKEPLGPALAH

SEQ ID NO: 832707 - protein, 391 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTSPLAQPLPIELRYPGGDCSSDIWI

SEQ ID NO: 832708 - protein, 339 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKSPLAQPLPIELRYPGGDCSSDIWI

SEQ ID NO: 832709 - protein, 150 aa, Homo sapiens
PSLLSGEQRPLTPAQQTRRDQSVPVGSMATKCGNCGPGYSTPLEAMKGNCPWSESQRPTTDSTAGGGGTSDLAPTLWHTQHFPYLSFPPCRPCCLLSTVQDPGKRSSTCPAFTETQALRPQIIWPLWMLTPSLPSIARLGGAWAPATLRP

SEQ ID NO: 832710 - protein, 208 aa, Homo sapiens
MSSIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAH

SEQ ID NO: 832711 - protein, 393 aa, Homo sapiens; identical to SEQ ID NO: 832701

SEQ ID NO: 832712 - protein, 482 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGENPPMCQQEPWAYIPLLSAPNLPPPHFPPVAPESKRDGIGCTACSDCSSVFLIPPIHFLTFCPDGGPVFAHAFQPLMLSLSSGPTPTPGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAH

SEQ ID NO: 832713 - protein, 261 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGENPPMCQQEPWAYIPLLSAPNLPPPHFPPVAPESKRDGIGCTACSDCSSVFLIPPIHFLTFCPDWWPSLCPCLPTSDAEPILRPHSHPRTVREPLICMGLAAP

SEQ ID NO: 832714 - protein, 393 aa, Homo sapiens; identical to SEQ ID NO: 832701

SEQ ID NO: 832715 - protein, 393 aa, Homo sapiens; identical to SEQ ID NO: 832701

SEQ ID NO: 832716 - protein, 159 aa, Homo sapiens
CTKCNIKIHETQPLLNLKLDRVMQDIVYELVPGLQDSEEKRIREFYQSRGLDRVTQPTGEEPALSNLGLHFVGSAAHEVVKGKRVAGGPQMIQLSLDGKRLYITTSLYSAWDKQFYPDLIREGSVMLQVDVDTVKGGLKLNPNFLVDFGKEPLGPALAH

SEQ ID NO: 832717 - protein, 382 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKLSGVRSDQGTYEDYVGGLRVFDKEGNGTVMGAEIRHVLVTLGEKMTEEEVEMLLAGHEDSNGCINYM

SEQ ID NO: 832718 - protein, 110 aa, Homo sapiens
MPNLKDELHHSGWNTCSSCFGDSTKSRTKLVLPSLISSRIYVVDVGSEPRAPKLHKVIEPKDIHAKCELAFSTIQRFYKNEGGTWSVEKVIQVPIELRYPGGDCSSDIWI

SEQ ID NO: 832719 - protein, 1483 aa, Homo sapiens
MAPLLGRKPFPLVKPLPGEEPLFTIPHTQEAFRTREEYEARLERYSERIWTCKSTGSSQLTHKEAWEEEQEVAELLKEEFPAWYEKLVLEMVHHNTASLEKLVDTAWLEIMTKYAVGEECDFEVGKEKMLKVKIVKIHPLEKVDEEATEKKSDGACDSPSSDKENSSQIAQDHQKKETVVKEDEGRRESINDRARRSPRKLPTSLKKGERKWAPPKFLPHKYDVKLQNEDKIISNVPADSLIRTERPPNKEIVRYFIRHNALRAGTGENAPWVVEDELVKKYSLPSKFSDFLLDPYKYMTLNPSTKRKNTGSPDRKPSKKSKTDNSSLSSPLNPKLWCHVHLKKSLSGSPLKVKNSKNSKSPEEHLEEMMKMMSPNKLHTNFHIPKKGPPAKKPGKHSDKPLKAKGRSKGILNGQKSTGNSKSPKKGLKTPKTKMKQMTLLDMAKGTQKMTRAPRNSGGTPRTSSKPHKHLPPAALHLIAYYKENKDREDKRSALSCVISKTARLLSSEDRARLPEELRSLVQKRYELLEHKKRWASMSEEQRKEYLKKKREELKKKLKEKAKERREKEMLERLEKQKRYEDQELTGKNLPAFRLVDTPEGLPNTLFGDVAMVVEFLSCYSGLLLPDAQYPITAVSLMEALSADKGGFLYLNRVLVILLQTLLQDEIAEDYGELGMKLSEIPLTLHSVSELVRLCLRRSDVQEESEGSDTDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYRFSWPFREPVTRDEAEDYYDVITHPMDFQTVQNKCSCGSYRSVQEFLTDMKQVFTNAEVYNCRGSHVLSCMVKTEQCLVALLHKHLPGHPYVRRKRKKFPDRLAEDEGDSEPEAVGQSRGRRQKK

SEQ ID NO: 832720 - protein, 1483 aa, Homo sapiens; identical to SEQ ID NO: 832719

SEQ ID NO: 832721 - protein, 1510 aa, Homo sapiens
MAPLLGRKPFPLVKPLPGEEPLFTIPHTQEAFRTREEYEARLERYSERIWTCKSTGSSQLTHKEAWEEEQEVAELLKEEFPAWYEKLVLEMVHHNTASLEKLVDTAWLEIMTKYAVGEECDFEVGKEKMLKVKIVKIHPLEKVDEEATEKKSDGACDSPSSDKENSSQIAQDHQKKETVVKEDEGRRESINDRARRSPRKLPTSLKKGERKWAPPKFLPHKYDVKLQNEDKIISNVPADSLIRTERPPNKEIVRYFIRHNALRAGTGENAPWVVEDELVKKYSLPSKFSDFLLDPYKYMTLNPSTKRKNTGSPDRKPSKKSKTDNSSLSSPLNPKLWCHVHLKKSLSGSPLKVKNSKNSKSPEEHLEEMMKMMSPNKLHTNFHIPKKGPPAKKPGKHSDKPLKAKGRSKGILNGQKSTGNSKSPKKGLKTPKTKMKQMTLLDMAKGTQKMTRAPRNSGGTPRTSSKPHKHLPPAALHLIAYYKENKDREDKRSALSCVISKTARLLSSEDRARLPEELRSLVQKRYELLEHKKRWASMSEEQRKEYLKKKREELKKKLKEKAKERREKEMLERLEKQKRYEDQELTGKNLPAFRLVDTPEGLPNTLFGDVAMVVEFLSCYSGLLLPDAQYPITAVSLMEALSADKGGFLYLNRVLVILLQTLLQDEIAEDYGELGMKLSEIPLTLHSVSELVRLCLRRSDVQEESEGSDTDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVDVKLKKRSVKQEDASGQEFETSLRNIVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYRFSWPFREPVTRDEAEDYYDVITHPMDFQTVQNKCSCGSYRSVQEFLTDMKQVFTNAEVYNCRGSHVLSCMVKTEQCLVALLHKHLPGHPYVRRKRKKFPDRLAEDEGDSEPEAVGQSRGRRQKK

SEQ ID NO: 832722 - protein, 698 aa, Homo sapiens
MATSPNRVLVILLQTLLQDEIAEDYGELGMKLSEIPLTLHSVSELVRLCLRRSDVQEESEGSDTDDNKDSAAFEDNEVQDEFLEKLEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYRFSWPFREPVTRDEAEDYYDVITHPMDFQTVQNKCSCGSYRSVQEFLTDMKQVFTNAEVYNCRGSHVLSCMVKTEQCLVALLHKHLPGHPYVRRKRKKFPDRLAEDEGDSEPEAVGQSRGRRQKK

SEQ ID NO: 832723 - protein, 127 aa, Homo sapiens
MSSLGASFVQIKELQFFECGGRFGSVYRAKEKVAVKLLKKKKAINVLKQFYGILEPNYGVKASLGSLYDNNSGRWWRFFFFNLYLLYSLVSLSPYSVSSPVFLSGDSISECHTELCIHQHHETVVVF

SEQ ID NO: 832724 - protein, 1483 aa, Homo sapiens; identical to SEQ ID NO: 832719

SEQ ID NO: 832725 - protein, 1371 aa, Homo sapiens
MAPLLGRKPFPLVKPLPGEEPLFTIPHTQEAFRTREEYEARLERYSERIWTCKSTGSSQLTHKEAWEEEQEVAELLKEEFPAWYEKLVLEMVHHNTASLEKLVDTAWLEIMTKYAVGEECDFEVGKEKMLKVKIVKIHPLEKVDEEATEKKSDGACDSPSSDKENSSQIAQDHQKKETVVKEDEGRRESINDRARRSPRKLPTSLKKGERKWAPPKFLPHKYDVKLQNEDKIISNVPADSLIRTERPPNKEIVRYFIRHNALRAGTGENAPWVVEDELVKKYSLPSKFSDFLLDPYKYMTLNPSTKRKNTGSPDRKPSKKSKTDNSSLSSPLNPKLWCHVHLKKSLSGSPLKVKNSKNSKSPEEHLEEMMKMMSPNKLHTNFHIPKKGPPAKKPGKHSDKPLKAKGRSKGILNGQKSTGNSKSPKKGLKTPKTKMKQMTLLDMAKGTQKMTRAPRNSGGTPRTSSKPHKHLPPAALHLIAYYKENKDREDKRSALSCVISKTARLLSSEDRARLPEELRSLVQKRYELLEHKKRWASMSEEQRKEYLKKKREELKKKLKEKAKERREKEMLERLEKQKRYEDQELTGKNLPAFRLVDTPEGLPNTLFGDVAMVVEFLSCYSGLLLPDAQYPITAVSLMEALSADKGGFLYLNRVLVILLQTLLQDEIAEDYGELGMKLSEIPLTLHSVSELVRLCLRRSDVQEESEGSDTDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYPPPRGLQLALQGA

SEQ ID NO: 832726 - protein, 1483 aa, Homo sapiens; identical to SEQ ID NO: 832719

SEQ ID NO: 832727 - protein, 1483 aa, Homo sapiens; identical to SEQ ID NO: 832719

SEQ ID NO: 832728 - protein, 1483 aa, Homo sapiens; identical to SEQ ID NO: 832719

SEQ ID NO: 832729 - protein, 827 aa, Homo sapiens
MSVKTELNIFIINPDELVIDRAIPVDDGTNSFSPGKSQVKRINSKIFQGSEEETDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYRFSWPFREPVTRDEAEDYYDVITHPMDFQTVQNKCSCGSYRSVQEFLTDMKQVFTNAEVYNCRGSHVLSCMVKTEQCLVALLHKHLPGHPYVRRKRKKFPDRLAEDEGDSEPEAVGQSRGRRQKK

SEQ ID NO: 832730 - protein, 1483 aa, Homo sapiens; identical to SEQ ID NO: 832719

SEQ ID NO: 832731 - protein, 1483 aa, Homo sapiens; identical to SEQ ID NO: 832719

SEQ ID NO: 832732 - protein, 1206 aa, Homo sapiens
MAPLLGRKPFPLVKPLPGEEPLFTIPHTQEAFRTREEYEARLERYSERIWTCKSTGSSQLTHKEAWEEEQEVAELLKEEFPAWYEKLVLEMVHHNTASLEKLVDTAWLEIMTKYAVGEECDFEVGKEKMLKVKIVKIHPLEKVDEEATEKKSDGACDSPSSDKENSSQIAQDHQKKETVVKEDEGRRESINDRARRSPRKLPTSLKKGERKWAPPKFLPHKYDVKLQNEDKIISNVPADSLIRTERPPNKEIVRYFIRHNALRAGTGENAPWVVEDELVKKYSLPSKFSDFLLDPYKYMTLNPSTKRKNTGSPDRKPSKKSKTDNSSLSSPLNPKLWCHVHLKKSLSGSPLKVKNSKNSKSPEEHLEEMMKMMSPNKLHTNFHIPKKGPPAKKPGKHSDKPLKAKGRSKGILNGQKSTGNSKSPKKGLKTPKTKMKQMTLLDMAKGTQKMTRAPRNSGGTPRTSSKPHKHLPPAALHLIAYYKENKDREDKRSALSCVISKTARLLSSEDRARLPEELRSLVQKRYELLEHKKRWASMSEEQRKEYLKKKREELKKKLKEKAKERREKEMLERLEKQKRYEDQELTGKNLPAFRLVDTPEGLPNTLFGDVAMVVEFLSCYSGLLLPDAQYPITAVSLMEALSADKGGFLYLNRVLVILLQTLLQDEIAEDYGELGMKLSEIPLTLHSVSELVRLCLRRSDVQEESEGSDTDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKKEKDEERKKNKEEEEREERRRKGRRGRKKKEEEEEEELRRRRGKKKKKKIEDGRRKKRKKNK

SEQ ID NO: 832733 - protein, 97 aa, Homo sapiens
RGESARGQDQGEKENPMRELRIRKLCLNICVGESGDRLTRAAKVLEQLTGQTPVFSKARYTVRSFGIRRNEKIAVHCTVRGAKAEEILEKGLKVQGV

SEQ ID NO: 832734 - protein, 109 aa, Homo sapiens
SLIKLSIPPPPLFLLSIMAQDQGEKENPMRELRIRKLCLNICVGESGDRLTRAAKVLEQLTGQTPVFSKARYTVRSFGIRRNEKIAVHCTVRGAKAEEILEKGLKVQGV

SEQ ID NO: 832735 - protein, 95 aa, Homo sapiens
SWRRSVVVCGGRLSLMVEAARKLCLNICVGESGDRLTRAAKVLEQLTGQTPVFSKARYTVRSFGIRRNEKIAVHCTVRGAKAEEILEKGLKVQGV

SEQ ID NO: 832736 - protein, 109 aa, Homo sapiens; identical to SEQ ID NO: 832734

SEQ ID NO: 832737 - protein, 107 aa, Homo sapiens
KALGRKLRFLFLLSIMAQDQGEKENPMRELRIRKLCLNICVGESGDRLTRAAKVLEQLTGQTPVFSKARYTVRSFGIRRNEKIAVHCTVRGAKAEEILEKGLKVQGV

SEQ ID NO: 832738 - protein, 109 aa, Homo sapiens; identical to SEQ ID NO: 832734

SEQ ID NO: 832739 - protein, 109 aa, Homo sapiens; identical to SEQ ID NO: 832734

SEQ ID NO: 832740 - protein, 107 aa, Homo sapiens; identical to SEQ ID NO: 832737

SEQ ID NO: 832741 - protein, 103 aa, Homo sapiens
MVQKVHSHSAEMEAQLSQALEELGGQKQRADMLEMELKMPKSQSSSAEQSFLFSREEADTLRLKVEELEGERSRLEEEKRMLEAQLERRALQGGEHIDLGYQI

SEQ ID NO: 832742 - protein, 91 aa, Homo sapiens
APIPERIRTLLELEKAEQSRESGSGRALERRRRRKVDRGGEGDDPAREELEPKRVRSSGPEAEEVQEEEKLEEETGGEGPPAPIPTTGSAG

SEQ ID NO: 832743 - protein, 95 aa, Homo sapiens; identical to SEQ ID NO: 832735

SEQ ID NO: 832744 - protein, 103 aa, Homo sapiens
GRLLLLNSRPRRRQDQGEKENPMRELRIRKLCLNICVGESGDRLTRAAKVLEQLTGQTPVFSKARYTVRSFGIRRNEKIAVHCTVRGAKAEEILEKGLKVQGV

SEQ ID NO: 832745 - protein, 164 aa, Homo sapiens
AGTWICFPLSVAIHGRPSLRGLLRPQPEEYGARNACWPKTSRAVRAKDAGLNSVTFPAIVLGAAPGTCRVLRSTQDQGEKENPMRELRIRKLCLNICVGESGDRLTRAAKVLEQLTGQTPVFSKARYTVRSFGIRRNEKIAVHCTVRGAKAEEILEKGLKVQGV

SEQ ID NO: 832746 - protein, 109 aa, Homo sapiens; identical to SEQ ID NO: 832734

SEQ ID NO: 832747 - protein, 161 aa, Homo sapiens
MGFPEGRPPKFYSNFGNLGPGVFRDSVASNNYKLHRVFFSCCGYAPAFSRPGPFSTGLKGEETPGPSCIMAQDQGEKENPMRELRIRKLCLNICVGESGDRLTRAAKVLEQLTGQTPVFSKARYTVRSFGIRRNEKIAVHCTVRGAKAEEILEKGLKVQGV

SEQ ID NO: 832748 - protein, 109 aa, Homo sapiens; identical to SEQ ID NO: 832734

SEQ ID NO: 832749 - protein, 111 aa, Homo sapiens
MVGTTHPSRELKRRGGDYYKPLGGVYRGGNPHEGHFLSRRGKNFGAPGRFSDSAEPIFTDEGVEIRNGSAPAHSHLQPRTTNPCPLTQPRTPHASTLTRASAVRHHTSRPT

SEQ ID NO: 832750 - protein, 98 aa, Homo sapiens
VFIPHFFEGSGRNPGYANPPLCTRKLCLNICVGESGDRLTRAAKVLEQLTGQTPVFSKARYTVRSFGIRRNEKIAVHCTVRGAKAEEILEKGLKVQGV

SEQ ID NO: 832751 - protein, 109 aa, Homo sapiens; identical to SEQ ID NO: 832734

SEQ ID NO: 832752 - protein, 109 aa, Homo sapiens; identical to SEQ ID NO: 832734

SEQ ID NO: 832753 - protein, 109 aa, Homo sapiens; identical to SEQ ID NO: 832734

SEQ ID NO: 832754 - protein, 109 aa, Homo sapiens; identical to SEQ ID NO: 832734

SEQ ID NO: 832755 - protein, 109 aa, Homo sapiens; identical to SEQ ID NO: 832734

SEQ ID NO: 832756 - protein, 109 aa, Homo sapiens; identical to SEQ ID NO: 832734

SEQ ID NO: 832757 - protein, 109 aa, Homo sapiens; identical to SEQ ID NO: 832734

SEQ ID NO: 832758 - protein, 109 aa, Homo sapiens; identical to SEQ ID NO: 832734

SEQ ID NO: 832759 - protein, 107 aa, Homo sapiens; identical to SEQ ID NO: 832737

SEQ ID NO: 832760 - protein, 97 aa, Homo sapiens; identical to SEQ ID NO: 832733

SEQ ID NO: 832761 - protein, 103 aa, Homo sapiens
AWYRPESLGSIMAQDQGEKENPMRELRIRKLCLNICVGESGDRLTRAAKVLEQLTGQTPVFSKARYTVRSFGIRRNEKIAVHCTVRGAKAEEILEKGLKVQGV

SEQ ID NO: 832762 - protein, 109 aa, Homo sapiens; identical to SEQ ID NO: 832734

SEQ ID NO: 832763 - protein, 103 aa, Homo sapiens; identical to SEQ ID NO: 832761

SEQ ID NO: 832764 - protein, 103 aa, Homo sapiens; identical to SEQ ID NO: 832761

SEQ ID NO: 832765 - protein, 103 aa, Homo sapiens; identical to SEQ ID NO: 832761

SEQ ID NO: 832766 - protein, 103 aa, Homo sapiens; identical to SEQ ID NO: 832761

SEQ ID NO: 832767 - protein, 103 aa, Homo sapiens
SGTSKLFLLSIMAQDQGEKENPMRELRIRKLCLNICVGESGDRLTRAAKVLEQLTGQTPVFSKARYTVRSFGIRRNEKIAVHCTVRGAKAEEILEKGLKVQGV

SEQ ID NO: 832768 - protein, 103 aa, Homo sapiens; identical to SEQ ID NO: 832761

SEQ ID NO: 832769 - protein, 103 aa, Homo sapiens; identical to SEQ ID NO: 832761

SEQ ID NO: 832770 - protein, 75 aa, Homo sapiens
SLIKLSIPPPPLFLLSIMAQDQGEKENPMRELRIRKLCLNICVGESGDRLTRAAKVLEQLTGQTPVFSKGAGSMS

SEQ ID NO: 832771 - protein, 126 aa, Homo sapiens
AWYRPESLGSIMAQDQGEKENPMRELRIRKLCLNICVGESGDRLTRAAKVLEQLTGQTPVFSKARYTVRSFGIRRNEKIAVHCTVRGAKAEEILEKGLKREYELRFIGRGDKPTEPGDSWLSKIES

SEQ ID NO: 832772 - protein, 103 aa, Homo sapiens; identical to SEQ ID NO: 832761

SEQ ID NO: 832773 - protein, 161 aa, Homo sapiens; identical to SEQ ID NO: 832747

SEQ ID NO: 832774 - protein, 106 aa, Homo sapiens
TGLSRGRVESAEAIMAQDQGEKENPMRELRIRKLCLNICVGESGDRLTRAAKVLEQLTGQTPVFSKARYTVRSFGIRRNEKIAVHCTVRGAKAEEILEKGLKVQGV

SEQ ID NO: 832775 - protein, 102 aa, Homo sapiens
WYVIFNSTGGRLIVHCHALWFSYSTCARKLCLNICVGESGDRLTRAAKVLEQLTGQTPVFSKARYTVRSFGIRRNEKIAVHCTVRGAKAEEILEKGLKVQGV

SEQ ID NO: 832776 - protein, 105 aa, Homo sapiens
GSYIMSRDLCEVQNPEWLVTWHTGHSGSPVLQLAESEEVQLPASHIVEIDIHYCAGPWFIRIYDIARYTVRSFGIRRNEKIAVHCTVRGAKAEEILEKGLKVQGV

SEQ ID NO: 832777 - protein, 112 aa, Homo sapiens
GRLLLLNSRPRRRGNTSIWGIKYDPSIGIYGLDFYVVLGRPGFSIADKKRRTGCIGAKHRISKEEAMRWFQQKYDGIILPGQIKFPVSIQKRAINKFSGEILQNKKVDAAAN

SEQ ID NO: 832778 - protein, 102 aa, Homo sapiens
LVAWLIVWLLEITESQSADAEPPPPQEAAGCIGAKHRISKEEAMRWFQQKYDGIILPGQIKFPVSIQKRAINKFSGEIVQPNEPRQEPHKEPPDEPLYSARN

SEQ ID NO: 832779 - protein, 103 aa, Homo sapiens; identical to SEQ ID NO: 832767

SEQ ID NO: 832780 - protein, 106 aa, Homo sapiens; identical to SEQ ID NO: 832774

SEQ ID NO: 832781 - protein, 109 aa, Homo sapiens; identical to SEQ ID NO: 832734

SEQ ID NO: 832782 - protein, 88 aa, Homo sapiens
AEQASSSCSPSWRRKLCLNICVGESGDRLTRAAKVLEQLTGQTPVFSKARYTVRSFGIRRNEKIAVHCTVRGAKAEEILEKGLKVQGV

SEQ ID NO: 832783 - protein, 109 aa, Homo sapiens; identical to SEQ ID NO: 832734

SEQ ID NO: 832784 - protein, 109 aa, Homo sapiens; identical to SEQ ID NO: 832734

SEQ ID NO: 832785 - protein, 103 aa, Homo sapiens; identical to SEQ ID NO: 832761

SEQ ID NO: 832786 - protein, 103 aa, Homo sapiens; identical to SEQ ID NO: 832761

SEQ ID NO: 832787 - protein, 103 aa, Homo sapiens; identical to SEQ ID NO: 832761

SEQ ID NO: 832788 - protein, 103 aa, Homo sapiens; identical to SEQ ID NO: 832761

SEQ ID NO: 832789 - protein, 164 aa, Homo sapiens; identical to SEQ ID NO: 832745

SEQ ID NO: 832790 - protein, 120 aa, Homo sapiens
AWYRPESLGSIMAQDQGEKENPMRELRIRKLCLNICVGESGDRLTRAAKVLEQLTGQTPVFSKARYTVRSFGIRRNEKIAVHCTVRGAKAEEILEKGLKGPEFSYEPPLVLTWFGRPMSC

SEQ ID NO: 832791 - protein, 116 aa, Homo sapiens
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 832792 - protein, 141 aa, Homo sapiens
AGTVLSRIIGALPACRSAPGRAGATMEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 832793 - protein, 118 aa, Homo sapiens
GNKYHSFAIRYKYSSDYDHTRLLRRYPVVYVESDAWKLPIKRMPDAGRGNCNCWYPDGAQESYKLGSHASGRHRYRRPIQIAVSPDPAHSMWNKHLSDAYYGHMSLLSTIVVNVLCKC

SEQ ID NO: 832794 - protein, 116 aa, Homo sapiens; identical to SEQ ID NO: 832791

SEQ ID NO: 832795 - protein, 116 aa, Homo sapiens; identical to SEQ ID NO: 832791

SEQ ID NO: 832796 - protein, 174 aa, Homo sapiens
MRIPETLADELVGGGGRADANMQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQVLCFAFHPRAVQLAARRSVVHTNNLRSQEEGSNKVVLSLKGSLLAPGPVALEPQ

SEQ ID NO: 832797 - protein, 200 aa, Homo sapiens
MCVVGDGFPSRLAAGAACADQDLAAVEEGGTAFREDGSSKMMPKDANMQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQVLCFAFHPRAVQLAARRSVVHTNNLRSQEEGSNKVVLSLKGSLLAPGPVALEPQ

SEQ ID NO: 832798 - protein, 153 aa, Homo sapiens
MQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQVLCFAFHPRAVQLAARRSVVHTNNLRSQEEGSNKVVLSLKGSLLAPGPVALEPQ

SEQ ID NO: 832799 - protein, 111 aa, Homo sapiens
MQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQAMLAFTLVPGTE

SEQ ID NO: 832800 - protein, 153 aa, Homo sapiens; identical to SEQ ID NO: 832798

SEQ ID NO: 832801 - protein, 121 aa, Homo sapiens
LYRIFVLVTPWTPDLDAIFFFFSEAAELVGGGGRAGSRRAESGLGAAGGCRGLGGRRGGPELAHAGQSRQGGWAGLARPRLGAQTGAQEASAVLERSLPALPASVTPRGLGREEVLGADPS

SEQ ID NO: 832802 - protein, 153 aa, Homo sapiens; identical to SEQ ID NO: 832798

SEQ ID NO: 832803 - protein, 121 aa, Homo sapiens; identical to SEQ ID NO: 832801

SEQ ID NO: 832804 - protein, 191 aa, Homo sapiens
LYRIFVLVTPWTPDLDAIFFFFSEAAELVGGGGRADANMQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQVLCFAFHPRAVQLAARRSVVHTNNLRSQEEGSNKVVLSLKGSLLAPGPVALEPQ

SEQ ID NO: 832805 - protein, 153 aa, Homo sapiens; identical to SEQ ID NO: 832798

SEQ ID NO: 832806 - protein, 153 aa, Homo sapiens; identical to SEQ ID NO: 832798

SEQ ID NO: 832807 - protein, 153 aa, Homo sapiens; identical to SEQ ID NO: 832798

SEQ ID NO: 832808 - protein, 153 aa, Homo sapiens; identical to SEQ ID NO: 832798

SEQ ID NO: 832809 - protein, 121 aa, Homo sapiens; identical to SEQ ID NO: 832801

SEQ ID NO: 832810 - protein, 121 aa, Homo sapiens; identical to SEQ ID NO: 832801

SEQ ID NO: 832811 - protein, 128 aa, Homo sapiens
VKAKIQDKEGIPPDQQRLIFAGKQLEDGRTLSDYNIQKESTLHLGVAPAKVALLSLLSASLPRNTTADKMILPQVLCFAFHPRAVQLAARRSVVHTNNLRSQEEGSNKVVLSLKGSLLAPGPVALEPQ

SEQ ID NO: 832812 - protein, 184 aa, Homo sapiens
CSVRKRFRRRLGGFRFRYLLFLQRGGRADANMQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQVLCFAFHPRAVQLAARRSVVHTNNLRSQEEGSNKVVLSLKGSLLAPGPVALEPQ

SEQ ID NO: 832813 - protein, 181 aa, Homo sapiens
MQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQVCVLRCLGGCGGCRSRGMPSPTPPVSVQVLCFAFHPRAVQLAARRSVVHTNNLRSQEEGSNKVVLSLKGSLLAPGPVALEPQ

SEQ ID NO: 832814 - protein, 115 aa, Homo sapiens
MQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQKCGSHQQPAFPRRRFK

SEQ ID NO: 832815 - protein, 181 aa, Homo sapiens; identical to SEQ ID NO: 832813

SEQ ID NO: 832816 - protein, 153 aa, Homo sapiens; identical to SEQ ID NO: 832798

SEQ ID NO: 832817 - protein, 185 aa, Homo sapiens
HGIWDAGGREDANMQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQVLCFAFHPRAVQLAARRSVVHTNNLRSQEEGSNKTWSRYVAQNGFALGPSSSAAASQSAGITGVRHLAGPCFD

SEQ ID NO: 832818 - protein, 153 aa, Homo sapiens; identical to SEQ ID NO: 832798

SEQ ID NO: 832819 - protein, 153 aa, Homo sapiens; identical to SEQ ID NO: 832798

SEQ ID NO: 832820 - protein, 153 aa, Homo sapiens; identical to SEQ ID NO: 832798

SEQ ID NO: 832821 - protein, 153 aa, Homo sapiens; identical to SEQ ID NO: 832798

SEQ ID NO: 832822 - protein, 153 aa, Homo sapiens; identical to SEQ ID NO: 832798

SEQ ID NO: 832823 - protein, 153 aa, Homo sapiens; identical to SEQ ID NO: 832798

SEQ ID NO: 832824 - protein, 153 aa, Homo sapiens; identical to SEQ ID NO: 832798

SEQ ID NO: 832825 - protein, 184 aa, Homo sapiens; identical to SEQ ID NO: 832812

SEQ ID NO: 832826 - protein, 172 aa, Homo sapiens
MQIFVKTLTGKTITLEVEPSDTIENVKAKIQDKEGIPPDQQRLIFAGKQLEDGRTLSDYNIQKESTLHLGVAPAKVALLSLLSASLPRNTTADKMILPQVLCFAFHPRAVQLAARRSVVHTNNLRSQEEGSNKTWSRYVAQNGFALGPSSSAAASQSAGITGVRHLAGPCFD

SEQ ID NO: 832827 - protein, 174 aa, Homo sapiens; identical to SEQ ID NO: 832796

SEQ ID NO: 832828 - protein, 173 aa, Homo sapiens
LYRIFVLVTPWTPDLDAIFFFFSEAAELVGGGGRADANMQIFVKTLTGKTITLEVEPSDTIENVKAGKQLEDGRTLSDYNIQKESTLHLGVAPAKVALLSLLSASLPRNTTADKMILPQVLCFAFHPRAVQLAARRSVVHTNNLRSQEEGSNKVVLSLKGSLLAPGPVALEPQ

SEQ ID NO: 832829 - protein, 121 aa, Homo sapiens; identical to SEQ ID NO: 832801

SEQ ID NO: 832830 - protein, 68 aa, Homo sapiens
LYRIFVLVTPWTPDLDAIFFFFSEAAELVGGGGRADANMQIFVKTLTGKTITLEVEPSDTIENVKCGL

SEQ ID NO: 832831 - protein, 203 aa, Homo sapiens
CCVARINFGSWIAIPPVEKMVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKVGKGIVFLTIVKEQ

SEQ ID NO: 832832 - protein, 927 aa, Homo sapiens
CCVARINFGSWIAIPPVEKMVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNSKSSVEFPMVKSGSTS

SEQ ID NO: 832833 - protein, 109 aa, Homo sapiens
DSSLFPPLQMYMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 832834 - protein, 116 aa, Homo sapiens
TYKQLPTINTPANKVKSPMYIQTTTLTVSMSLSASVSLGMLYMPKVYIIIFHPEQNVQKRKRSFKAVVTAATMQSKLIQKGNDRPNGEVKSELCESLETNSKSSVEFPMVKSGSTS

SEQ ID NO: 832835 - protein, 115 aa, Homo sapiens
GGGTTPINRKYSHPEYFMYIQTTTLTVSMSLSASVSLGMLYMPKVYIIIFHPEQNVQKRKRSFKAVVTAATMQSKLIQKGNDRPNGEVKSELCESLETNSKSSVEFPMVKSGSTS

SEQ ID NO: 832836 - protein, 927 aa, Homo sapiens
CCVARINFGSWIAIPPVEKMVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 832837 - protein, 951 aa, Homo sapiens
CCVARINFGSWIAIPPVEKMVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGCRRGIQMSLPWPTLFTPSFSSSVGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 832838 - protein, 120 aa, Homo sapiens
LFCIWLGIGGGGGVFRVTPDTFMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 832839 - protein, 300 aa, Homo sapiens
CCVARINFGSWIAIPPVEKMVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGYPSLFGIQGCLHECFAILCQVVYQFLLLMQLSDAQTVY

SEQ ID NO: 832840 - protein, 203 aa, Homo sapiens
MLKAGRDRGGLPAGKMALAMLVLVVSPWSAARGVLRNYWERLLRKLPQSRPGFPSPPWGPALAVQGPAMFTEPANDTSGSKENSSLLDSIFWMAAPKNRRTIEVNRCRRRNPQKLIKVKNNIDVCPECGHLKQKHVLCAYCYEKVCKETAEIRRQIGKQEGGPFKAPTIETVVLYTGETPSEQDQGKRIIERDRKRPSWFTQN

SEQ ID NO: 832841 - protein, 135 aa, Homo sapiens
RPPTTTKFAAASTENSSLLDSIFWMAAPKNRRTIEVNRCRRRNPQKLIKVKNNIDVCPECGHLKQKHVLCAYCYEKVCKETAEIRRQIGKQEGGPFKAPTIETVVLYTGETPSEQDQGKRIIERDRKRPSWFTQN

SEQ ID NO: 832842 - protein, 185 aa, Homo sapiens
MLKAGRDRGGLPAGKMALAMLVLVVSPWSAARGVLRNYWERLLRKLPQSRPGFPSPPWGPALAVQGPAMFTEPANDTSGSKENSSLLDSIFWMAAPKNRRTIEVNRCRRRNPQKLIKVKNNIDVCPECGHLKQKHVLCAYCYGGPFKAPTIETVVLYTGETPSEQDQGKRIIERDRKRPSWFTQN

SEQ ID NO: 832843 - protein, 138 aa, Homo sapiens
MLKAGRDRGGLPAGKMALAMLVLVVSPWSAARGVLRNYWERLLRKLPQSRPGFPSPPWGPALAVQGPAMFTEPANDTSGSKENSSLLDSIFWMAAPKNRRTIEVNRCRRRNPQKLIKVKVFSLPVKVRWNWMVYDDLM

SEQ ID NO: 832844 - protein, 254 aa, Homo sapiens
MDNYADLSDTELTTLLRRYNIPHGPVVGSTRRLYEKKIFEYETQRRRLSPPSSSAASSYSFSDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832845 - protein, 254 aa, Homo sapiens; identical to SEQ ID NO: 832844

SEQ ID NO: 832846 - protein, 254 aa, Homo sapiens; identical to SEQ ID NO: 832844

SEQ ID NO: 832847 - protein, 182 aa, Homo sapiens [sequence omitted]

SEQ ID NO: 832848 - protein, 219 aa, Homo sapiens
MDNYADLSDTELTTLLRRYNIPHGPVVDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832849 - protein, 325 aa, Homo sapiens
MDNYADLSDTELTTLLRRYNIPHGPVVGSTRRLYEKKIFEYETQRRRLSPPSSSAASSYSFSDLNSTRGDADMYDLPKKEDALLYQSKGKAGVGGHAGTFTRLRQGPRSQGGPETSVPTTPAALGGRNCYRSRNGIQIRAIRPGGAHRCPLCYRCPPSQGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832850 - protein, 191 aa, Homo sapiens
MDNYADLSDTELTTLLRRYNIPHGPVVGSTRRLYEKKIFEYETQRRRLSPPSSSAASSYSFSDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSLSFC

SEQ ID NO: 832851 - protein, 192 aa, Homo sapiens
MVRGLVVNRPTQIFDLPEEDALLYRAGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832852 - protein, 172 aa, Homo sapiens
FLLGGRWASQECLLPLPCPTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832853 - protein, 175 aa, Homo sapiens
MDNYADLSDTELTTLLRRYNIPHGPVVGSTRRLYEKKIFEYETQRRRLSPPSSSAASSYSFSDLNSTRGDADMYDLPKKEDALLYQSKGYNDDYYEESYFTTRTYGEPESAGPSRAVRQSVTSFPDADAFHHQVHDDDLLSSSEEECKDSVLLGLGWARIARSRSGASCCFSWSL

SEQ ID NO: 832854 - protein, 137 aa, Homo sapiens
MVALPASPLALTLFLQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832855 - protein, 302 aa, Homo sapiens
MDNYADLSDTELTTLLRRYNIPHGPVVGSTRRLYEKKIFEYETQRRRLSPPSSSAASSYSFSDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQVRGPLKGQRAWAKPGGEPVSSTGGGPRGLFVGRHPKFPFSGGTRLLAFGGNPFAS

SEQ ID NO: 832856 - protein, 254 aa, Homo sapiens; identical to SEQ ID NO: 832844

SEQ ID NO: 832857 - protein, 182 aa, Homo sapiens [sequence omitted]

SEQ ID NO: 832858 - protein, 288 aa, Homo sapiens
IALVYVERVRCARAAPAVSRSVSRCSRRAGLRLSPHRQTYRFRIDDTCWRRYHPARACSRYRSTRRRSSERLPREPKERRRLSPPSSSAASSYSFSDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832859 - protein, 303 aa, Homo sapiens
MDNYADLSDTELTTLLRRYNIPHGPVVGSTRRLYEKKIFEYETQRRRLSPPSSSAASSYSFSGESLACGDSLGRGEDGVARVWQGGRSRAALEKGEGSLGGQTVLSPPFNPDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832860 - protein, 280 aa, Homo sapiens
MDNYADLSDTELTTLLRRYNIPHGPVVGSTRRLYEKKIFEYETQRRRLSPPSSSAASSYSFSDLNSTRGDADMYDLPKKEDALLYQSKGYNDDYYEESYFTTRTYGEPESAGPSRAVRQSVTSFPDADAFHHQVHDDDLLSSSEEECKDRCVVGEPRDGLVLGPAPGPLAPLFCLRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832861 - protein, 351 aa, Homo sapiens
MDNYADLSDTELTTLLRRYNIPHGPVVGSTRRLYEKKIFEYETQRRRLSPPSSSAASSYSFSDLNSTRGDADMYDLPKKEDALLYQSKGKAGVGGHAGTFTRLRQGPRSQGGPETSVPTTPAALGGRNCYRSRNGIQIRAIRPGGAHRCPLCYRCPPSQGYNDDYYEESYFTTRTYGEPESAGPSRAVRQSVTSFPDADAFHHQVHDDDLLSSSEEECKDRCVVGEPRDGLVLGPAPGPLAPLFCLRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832862 - protein, 282 aa, Homo sapiens
MQICMIFPRKRTLYSTRARVRQGLGGHAGTFTRLRQGPRSQGGPETSVPTTPAALGGRNCYRSRNGIQIRAIRPGGAHRCPLCYRCPPSQGYNDDYYEESYFTTRTYGEPESAGPSRAVRQSVTSFPDADAFHHQVHDDDLLSSSEEECKDRCVVGEPRDGLVLGPAPGPLAPLFCLRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 832863 - protein, 217 aa, Homo sapiens
MDNYADLSDTELTTLLRRYNIPHGPVVGSTRRLYEKKIFEYETQRRRLSPPSSSAASSYSFSDLNSTRGDADMYDLPKKEDALLYQSKGKAGVGGHAGTFTRLRQGPRSQGGPETSVPTTPAALGGRNCYRSRNGIQIRAIRPGGAHRCPLCYRCPPSQGYNDDYYEESYFTTRTYGEPESAGPSRAVRQSVTSFPDADAFHHQVSWLAGVLYLGTT

SEQ ID NO: 832864 - protein, 115 aa, Homo sapiens
MVRGFDTSPLLGSPHLESRVLTIPLSSEDLEPSSSAVLVGRVITTFPVILAIVFVYFFFDNDIHRALALQVPLIFDSQGEHIGPHLQPSHSSNTAVSILELHPIRSLCFFPGDMR

SEQ ID NO: 832865 - protein, 1127 aa, Homo sapiens
GGGVSGRRRCPGRLRREVAVRVGSPHYLLPLPPPPPGEGSEGWGSPSPWTRRRRRPPRAGAPLCGPEPRVLVLPVWRAMEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 832866 - protein, 1073 aa, Homo sapiens
MRSGAGAPLCGPEPRVLVLPVWRAMEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 832867 - protein, 691 aa, Homo sapiens
MEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 832868 - protein, 486 aa, Homo sapiens
MQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 832869 - protein, 1049 aa, Homo sapiens
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 832870 - protein, 1202 aa, Homo sapiens
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGGALGARASRSVHSLCGRLLSLAPPECVTEQPTVLAKHFVPFCLMKTEGQICPELHWTKCLQDPLRVLLPLGGGAGPVVFLCLGILLMFPTWSSAFPTAPGSQGQGPWTCLLLLTSLCFMGRDETQARVCQLTTFQPALFSCLPIFIIWQVLSFCQCLRADRRAFPCTNSKMTLSDGTGRSGQVVGLPSSAGLGHLARVSLIMDAMGQVSLVYES

SEQ ID NO: 832871 - protein, 917 aa, Homo sapiens
MIISALVPKEGDGVLGQGDHLVGACVGHRGESTALFTVRFAVVELVAPSESTTVKLKGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 832872 - protein, 498 aa, Homo sapiens
GGGVSGRRRCPGRLRREVAVRVGSPHYLLPLPPPPPGEGSEGWGSPSPWTRRRRRPPRAGAPLCGPEPRVLVLPVWRAMEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPGSTPHGNCQDLRLAPSEATA

SEQ ID NO: 832873 - protein, 337 aa, Homo sapiens
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHVIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 832874 - protein, 337 aa, Homo sapiens; identical to SEQ ID NO: 832873

SEQ ID NO: 832875 - protein, 415 aa, Homo sapiens [sequence omitted]

SEQ ID NO: 832876 - protein, 337 aa, Homo sapiens; identical to SEQ ID NO: 832873

SEQ ID NO: 832877 - protein, 116 aa, Homo sapiens
MNIRAIRRARANPQLGAYAPPPHVIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 832878 - protein, 449 aa, Homo sapiens
VLGSSVFTVLGHELLGSCDFHFPFRIPGYIWEAGGRVWLLHRCTAGRGIHTAQNSWILLSLCQRKIPWTRGPCLGVRVREEEAGTRVKENLPVWTVTGELQGKPLGNPAAGTMNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHVIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 832879 - protein, 337 aa, Homo sapiens; identical to SEQ ID NO: 832873

SEQ ID NO: 832880 - protein, 232 aa, Homo sapiens
KGSRHDVEDPPSSAVESVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHVIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 832881 - protein, 120 aa, Homo sapiens
SDSKTGAEPGIALRLESDFSPPPAVPLNCRDRGGGWGASGSDGFKKLPRLNSGSDCLRHGQLTQQTLNPEDVRQGISGRPEDVSGYYTDAQLDVGSTQLRTVGSCSVSVRGRSLGKLGIV

SEQ ID NO: 832882 - protein, 190 aa, Homo sapiens
MVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVCYAIGPLLIFGLAPGFVHWVFVFLADFPASFFFLSSLGGIAKLENSSRHRSLVKIL

SEQ ID NO: 832883 - protein, 482 aa, Homo sapiens
MVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEVIQKCNARWTTEEQLLAVQAIRKYGRDFQAISDVIGNKSVVQVKNFFVNYRRRFNIDEVLQEWEAEHGKEETNGPSNQKPVKSPDNSIKMPEEEDEAPVLDVRYASAS

SEQ ID NO: 832884 - protein, 388 aa, Homo sapiens
MVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEPSGNMAEIFRQSQT

SEQ ID NO: 832885 - protein, 120 aa, Homo sapiens
TQKRHPFQEKYFASINPKLLIPPTLSLSPWAAIRKYGRDFQAISDVIGNKSVVQVKNFFVNYRRRFNIDEVLQEWEAEHGKEETNGPSNQKPVKSPDNSIKMPEEEDEAPVLDVRYASAS

SEQ ID NO: 832886 - protein, 399 aa, Homo sapiens
MVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEVIQKCNARWTTEEQLLAVQGRGKFF

SEQ ID NO: 832887 - protein, 482 aa, Homo sapiens; identical to SEQ ID NO: 832883

SEQ ID NO: 832888 - protein, 169 aa, Homo sapiens [sequence omitted]

SEQ ID NO: 832889 - protein, 482 aa, Homo sapiens; identical to SEQ ID NO: 832883

SEQ ID NO: 832890 - protein, 378 aa, Homo sapiens
MVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEVGLC

SEQ ID NO: 832891 - protein, 205 aa, Homo sapiens
GARFLTNHRLCLPVRPLATQAFSTIGTSMTSYSYRQSSATSSFGGLGGGSVRFGPGVAFRAPSIHGGSGGRGVSVSSARFVSSSSSGGYGGGYGGVLTASDGLLAGNEKLTMQNLNDRLASYLDKVRALEAANGELEVKIRDWYQKQGPGPSRDYSHYYTTIQDLRDKILVVPPLRTPGLSCRSTTPVWLQMTSEPSLRRNRLCA

SEQ ID NO: 832892 - protein, 177 aa, Homo sapiens
MTSYSYRQSSATSSFGGLGGGSVRFGPGVAFRAPSIHGGSGGRGVSVSSARFVSSSSSGGYGGGYGGVLTASDGLLAGNEKLTMQNLNDRLASYLDKVRALEAANGELEVKIRDWYQKQGPGPSRDYSHYYTTIQDLRDKILVVPPLRTPGLSCRSTTPVWLQMTSEPSLRRNRLCA

SEQ ID NO: 832893 - protein, 177 aa, Homo sapiens; identical to SEQ ID NO: 832892

SEQ ID NO: 832894 - protein, 177 aa, Homo sapiens; identical to SEQ ID NO: 832892

SEQ ID NO: 832895 - protein, 177 aa, Homo sapiens; identical to SEQ ID NO: 832892

SEQ ID NO: 832896 - protein, 177 aa, Homo sapiens; identical to SEQ ID NO: 832892

SEQ ID NO: 832897 - protein, 177 aa, Homo sapiens; identical to SEQ ID NO: 832892

SEQ ID NO: 832898 - protein, 177 aa, Homo sapiens; identical to SEQ ID NO: 832892

SEQ ID NO: 832899 - protein, 177 aa, Homo sapiens; identical to SEQ ID NO: 832892

SEQ ID NO: 832900 - protein, 177 aa, Homo sapiens; identical to SEQ ID NO: 832892

SEQ ID NO: 832901 - protein, 177 aa, Homo sapiens; identical to SEQ ID NO: 832892

SEQ ID NO: 832902 - protein, 146 aa, Homo sapiens
MRSWPSRTRKDAEAWFTSRTEELNREVAGHTEQLQMSRSEVTDLRRTLQGLEIELQSQLSMKAALEDTLAETEARFGAPAWRISQALISGIEAQLGDVRADSERQNQEYQRLMDIKSRLEQEIATYRSLLEGQEDHYNNLSASKVL

SEQ ID NO: 832903 - protein, 146 aa, Homo sapiens; identical to SEQ ID NO: 832902

SEQ ID NO: 832904 - protein, 177 aa, Homo sapiens; identical to SEQ ID NO: 832892

SEQ ID NO: 832905 - protein, 188 aa, Homo sapiens
MTSYSYRQSSATSSFGGLGGGSVRFGPGVAFRAPSIHGGSGGRGVSVSSARFVSSSSSGGYGGGYGGVLTASDGLLAGNEKLTMQNLNDRLASYLDKVRALEAANGELEVKIRDWYQKQGPGPSRDYSHYYTTIQDLRDKILVVPPLRTPGLSCRSTTPVWLQMTSEPSECLCPGGCRSQDWGRGWGV

SEQ ID NO: 832906 - protein, 177 aa, Homo sapiens; identical to SEQ ID NO: 832892

SEQ ID NO: 832907 - protein, 177 aa, Homo sapiens; identical to SEQ ID NO: 832892

SEQ ID NO: 832908 - protein, 177 aa, Homo sapiens; identical to SEQ ID NO: 832892

SEQ ID NO: 832909 - protein, 177 aa, Homo sapiens; identical to SEQ ID NO: 832892

SEQ ID NO: 832910 - protein, 125 aa, Homo sapiens
MRSWPSRTRKDAEAWFTSRTEELNREVAGHTEQLQMSRSEVTDLRRTLQGLEIELQSQLSMKAALEDTLAETEVGDVRADSERQNQEYQRLMDIKSRLEQEIATYRSLLEGQEDHYNNLSASKVL

SEQ ID NO: 832911 - protein, 177 aa, Homo sapiens; identical to SEQ ID NO: 832892

SEQ ID NO: 832912 - protein, 181 aa, Homo sapiens
DRLLLYYLHSTLWIPNPCAAPGTDLAKILSDMRSQYEVMAEQNRKDAEAWFTSRTEELNREVAGHTEQLQMSRSEVTDLRRTLQGLEIELQSQLSMKAALEDTLAETEARFGAQLAHIQALISGIEAQLGDVRADSERQNQEYQRLDIVDSRSGAPILAKILSDIAEGQYEVMAEQNPEGC

SEQ ID NO: 832913 - protein, 196 aa, Homo sapiens
MCNRRDEIRITSVVDSAVTMTSYSYRQSSATSSFGGLGGGSVRFGPGVAFRAPSIHGGSGGRGVSVSSARFVSSSSSGGYGGGYGGVLTASDGLLAGNEKLTMQNLNDRLASYLDKVRALEAANGELEVKIRDWYQKQGPGPSRDYSHYYTTIQDLRDKILVVPPLRTPGLSCRSTTPVWLQMTSEPSLRRNRLCA

SEQ ID NO: 832914 - protein, 66 aa, Homo sapiens
LEDLPCRHSRTAGQDSCGATIENSRIVLQIDNARLAADDFRTKFETEQALRMSVEADIQRPAQGAG

SEQ ID NO: 832915 - protein, 177 aa, Homo sapiens; identical to SEQ ID NO: 832892

SEQ ID NO: 832916 - protein, 177 aa, Homo sapiens; identical to SEQ ID NO: 832892

SEQ ID NO: 832917 - protein, 177 aa, Homo sapiens; identical to SEQ ID NO: 832892

SEQ ID NO: 832918 - protein, 177 aa, Homo sapiens; identical to SEQ ID NO: 832892

SEQ ID NO: 832919 - protein, 177 aa, Homo sapiens; identical to SEQ ID NO: 832892

SEQ ID NO: 832920 - protein, 177 aa, Homo sapiens; identical to SEQ ID NO: 832892

SEQ ID NO: 832921 - protein, 177 aa, Homo sapiens; identical to SEQ ID NO: 832892

SEQ ID NO: 832922 - protein, 177 aa, Homo sapiens; identical to SEQ ID NO: 832892

SEQ ID NO: 832923 - protein, 177 aa, Homo sapiens; identical to SEQ ID NO: 832892

SEQ ID NO: 832924 - protein, 177 aa, Homo sapiens; identical to SEQ ID NO: 832892

SEQ ID NO: 832925 - protein, 177 aa, Homo sapiens; identical to SEQ ID NO: 832892

SEQ ID NO: 832926 - protein, 146 aa, Homo sapiens; identical to SEQ ID NO: 832902

SEQ ID NO: 832927 - protein, 177 aa, Homo sapiens; identical to SEQ ID NO: 832892

SEQ ID NO: 832928 - protein, 177 aa, Homo sapiens; identical to SEQ ID NO: 832892

SEQ ID NO: 832929 - protein, 146 aa, Homo sapiens; identical to SEQ ID NO: 832902

SEQ ID NO: 832930 - protein, 177 aa, Homo sapiens; identical to SEQ ID NO: 832892

SEQ ID NO: 832931 - protein, 177 aa, Homo sapiens; identical to SEQ ID NO: 832892

SEQ ID NO: 832932 - protein, 177 aa, Homo sapiens; identical to SEQ ID NO: 832892

SEQ ID NO: 832933 - protein, 158 aa, Homo sapiens
MTSYSYRQSSATSSFGGLGGGSVRFGPGVAFRAPSIHGGSGGRGVSVSSARFVSSSSSGGYGGGYGGVLTASVRAPPRHDFLQLSPVVGHVVLRRPGRRLRPGPSRDYSHYYTTIQDLRDKILVVPPLRTPGLSCRSTTPVWLQMTSEPSLRRNRLCA

SEQ ID NO: 832934 - protein, 207 aa, Homo sapiens
MTSYSYRQSSATSSFGGLGGGSVRFGPGVAFRAPSIHGGSGGRGVSVSSARFVSSSSSGGYGGGYGGVLTASDGLLAGNEKLTMQNLNDRLASYLDKVRALEAANGELEVKIRDWYQKQGPGPSRDYSHYYTTIQDLRDKGGRRPGRGKCSAPAAETQPRGPGEVPGGAAGRSPLGRGKVHRWGRVKGDRRRAGQDLGAGCRGRGGG

SEQ ID NO: 832935 - protein, 422 aa, Homo sapiens
WYAPDVRDPGRRTVPAAGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVLFALNQTLLQQESVRAGSLQASYTTEDLIKHYNCGDLSAVIFNHDTSQLPNFINTTLPPHEQVTAQEIDSYFRQELIYKRNERMGKRVMALLRENEDKICFFAFGAGHFLGNNTVIDILRQAGLEVDHTPAGQAIHSPAPQSPAPSPEGTSTSPAPVTPAAAVPEAPSVTPTAPPEDEDPALSPHLLLPDSLSQLEEFGRQRKWHKRQSTHQRP

SEQ ID NO: 832936 - protein, 379 aa, Homo sapiens
MHAALAGPLLAALLATARARPQPPDGGQCRPPGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVLFALNQTLLQQEECAGREPAGLLHHGGPHQALQLRRPQRSHLQPRHIPGHFLGNNTVIDILRQAGLEVDHTPAGQAIHSPAPQSPAPSPEGTSTSPAPVTPAAAVPEAPSVTPTAPPEDEDPALSPHLLLPDSLSQLEEFGRQRKWHKRQSTHQRP

SEQ ID NO: 832937 - protein, 437 aa, Homo sapiens
MHAALAGPLLAALLATARARPQPPDGGQCRPPGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVLFALNQTLLQQESVRAGSLQASYTTEDLIKHYNCGDLSAVIFNHDTSQLPNFINTTLPPHEQVTAQEIDSYFRQELIYKRNERMGKRVMALLRENEDKICFFAFGAGHFLGNNTVIDILRQAGLEVDHTPAGQAIHSPAPQSPAPSPEGTSTSPAPVTPAAAVPEAPSVTPTAPPEDEDPALSPHLLLPDSLSQLEEFGRQRKWHKRQSTHQRP

SEQ ID NO: 832938 - protein, 336 aa, Homo sapiens
MHAALAGPLLAALLATARARPQPPDGGQCRPPGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVGMQCPSPELTALGTWVLFSDCLSSPRGRGRQPESGPFSGRRGSAGQRGSTWLLWWYQLRVAYTGIWGKSLRVCFYFSSITCWGCTLLTCCACLGRKNFPQSIRESLQVPSSIL

SEQ ID NO: 832939 - protein, 95 aa, Homo sapiens
SPGTAFESGATPSCDALWEALNPQPSSRVCSRVGTPPLSSTKEKIAIVVLTSDVLRGLLGVFSPNHFNFFLDSRSCMPPPSFFPCQFPGDSYQLS

SEQ ID NO: 832940 - protein, 631 aa, Homo sapiens
QQLRLPRPPHQKAMVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 832941 - protein, 600 aa, Homo sapiens
QQLRLPRPPHQKAMVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 832942 - protein, 372 aa, Homo sapiens
QQLRLPRPPHQKAMVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 832943 - protein, 571 aa, Homo sapiens
QQLRLPRPPHQKAMVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPR

SEQ ID NO: 832944 - protein, 240 aa, Homo sapiens
QQLRLPRPPHQKAMVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPRESCVRPHPV

SEQ ID NO: 832945 - protein, 591 aa, Homo sapiens
PAAATPETPPPEGHGLPTDVRAPLPDCDPSAHFPPPDTARWRLRAADPLFRAGSRPRLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 832946 - protein, 271 aa, Homo sapiens
QQLRLPRPPHQKAMVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPRCASRLSPEHGSCDRPVMPMLRGGWPSAGLFHRVARRASWS

SEQ ID NO: 832947 - protein, 1170 aa, Homo sapiens
MNMFLYFQTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 832948 - protein, 1219 aa, Homo sapiens
RGPGSMAAAAGAPPPGPPQPPPPPPPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 832949 - protein, 1179 aa, Homo sapiens
RGPGSMAAAAGAPPPGPPQPPPPPPPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 832950 - protein, 773 aa, Homo sapiens
MLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 832951 - protein, 742 aa, Homo sapiens
MVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 832952 - protein, 369 aa, Homo sapiens
RGCVEWWSALTCPLQTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 832953 - protein, 450 aa, Homo sapiens
RGPGSMAAAAGAPPPGPPQPPPPPPPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDR

SEQ ID NO: 832954 - protein, 103 aa, Homo sapiens
MEQELAHAVNASSKSMDRVYGKPRTTEVAILAFSVLASSQCLPPSALPVRVHSPASPVHVRPSQCLFPAPNRACSAPRPHAYLPGFFQGLNCSFVLEMVNNFR

SEQ ID NO: 832955 - protein, 67 aa, Homo sapiens
DLAKRSRSGKFRLVTKFKKEKNNKNKEAHSSLGAPGTCLSPACVSGRPRLLDRPRSPGLCFLPWPCS

SEQ ID NO: 832956 - protein, 1219 aa, Homo sapiens; identical to SEQ ID NO: 832948

SEQ ID NO: 832957 - protein, 167 aa, Homo sapiens
RGPGSMAAAAGAPPPGPPQPPPPPPPEESSDSEPEAEPGSPQKLIRKVSTSGQIRQKVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASKGDGHT

SEQ ID NO: 832958 - protein, 1155 aa, Homo sapiens
RGPGSMAAAAGAPPPGPPQPPPPPPPEESSDSEPEAEPGSPQKLIRKVSTSGQIRQKVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 832959 - protein, 759 aa, Homo sapiens
MELAVTETNSPGHLGWLQVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 832960 - protein, 136 aa, Homo sapiens
MDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 832961 - protein, 1219 aa, Homo sapiens; identical to SEQ ID NO: 832948

SEQ ID NO: 832962 - protein, 425 aa, Homo sapiens
RGPGSMAAAAGAPPPGPPQPPPPPPPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQVPGQEGAQPGAERVRRLEGNHA

SEQ ID NO: 832963 - protein, 68 aa, Homo sapiens
RGLYIFFCSFLRPGFWKASCPPSCTSPLLVFVNSKSGDNQGVKFLRRFKQLLNPAQVFDLMNGGPHLG

SEQ ID NO: 832964 - protein, 558 aa, Homo sapiens
MRAAEQAGCMVSASRAGQPEAGPWSCSGVILSRSPGLVLCHGGIFVPFLRAGSEVLAAAGAVFLPGDSCRDDLRLHVQWAPTAAGPGGGAERGRPGLCTPQCASLEPGPPAPSRGRPLQPRLPAELLLLLSCPAFWAHFARLFGDEAAEQWRFSSAARDDEVSEDEEADQLRALGWFALLGVRLGQEEVEEERGPAMAVSPLGGRAKGAPLLVCGSPFGAFCPDIFLNTLSCGVLSNVAGPLLLTDARCLPGTEGGGVFTARPAGALVALVVAPLCWKAGEWVGFTLLCAAAPLFRAARDALHRLPHSTAALAALLPPEVGVPWGLPLRDSGPLWAAAAVLVECGTVWGSGVAVAPRLVVTCRHVSPREAARVLVRSTTPKSVAIWGRVVFATQETCPYDIAVVSLEEDLDDVPIPVPAEHFHEGEAVSVVGFGVFGQSCGPSVTSGILSAVVQVNGTPVMLQTTCAVHSGSSGGPLFSNHSGNLLGIITSNTRDNNTGATYPHLNFSIPITVLQPALQQYSQTQDLGGLRELDRAAEPVRVVWRLQRPLAEAPRSKL

SEQ ID NO: 832965 - protein, 186 aa, Homo sapiens
MSFVSLAPRSVAIWGRVVFATQETCPYDIAVVSLEEDLDDVPIPVPAEHFHEGEAVSVVGFGVFGQSCGPSVTSGILSAVVQVNGTPVMLQTTCAVHSGSSGGPLFSNHSGNLLGIITSNTRDNNTGATYPHLNFSIPITVLQPALQQYSQTQDLGGLRELDRAAEPVRVVWRLQRPLAEAPRSKL

SEQ ID NO: 832966 - protein, 195 aa, Homo sapiens
QAVLVWNFRMREAAQPDGSVAIWGRVVFATQETCPYDIAVVSLEEDLDDVPIPVPAEHFHEGEAVSVVGFGVFGQSCGPSVTSGILSAVVQVNGTPVMLQTTCAVHSGSSGGPLFSNHSGNLLGIITSNTRDNNTGATYPHLNFSIPITVLQPALQQYSQTQDLGGLRELDRAAEPVRVVWRLQRPLAEAPRSKL

SEQ ID NO: 832967 - protein, 117 aa, Homo sapiens
MSPSLCPLSTSMKVNGTPVMLQTTCAVHSGSSGGPLFSNHSGNLLGIITSNTRDNNTGATYPHLNFSIPITVLQPALQQYSQTQDLGGLRELDRAAEPVRVVWRLQRPLAEAPRSKL

SEQ ID NO: 832968 - protein, 84 aa, Homo sapiens
PSVTSGILSAVVQVNGTPVMLQTTCAVHSGSSGGPLFSNHSGNLLGNQLFGPLPPSHLPEPQSHPMSACGQPQCTLCLGKWWAL

SEQ ID NO: 832969 - protein, 452 aa, Homo sapiens
MRAAEQAGCMVSASRAGQPEAGPWSCSGVILSRSPGLVLCHGGIFVPFLRAGSEVLAAAGAVFLPGDSCRDDLRLHVQWAPTAAGPGGGAERGRPGLCTPQCASLEPGPPAPSRGRPLQPRLPAELLLLLSCPAFWAHFARLFGDEAAEQWRFSSAARDDEVSEDEEADQLRALGWFALLGVRLGQEEVEEERGPAMAVSPLGGRAKGAPLLVCGSPFGAFCPDIFLNTLSCGVLSNVAGPLLLTDARCLPGTEGGGVFTARPAGALVALVVAPLCWKAGEWVGFTLLCAAPPFSAPPATRFTACRTAPLPWPPFCRQRWASRGVCPPRLRAPVGSRGSVGGVRHRMGLRSGCGTPPCSDLVGTCPLGKQPGSWCAPPPPSIITSNTRDNNTGATYPHLNFSIPITVLQPALQQYSQTQDLGGLRELDRAAEPVRVVWRLQRPLAEAPRSKL

SEQ ID NO: 832970 - protein, 207 aa, Homo sapiens
PIGLDEEDGVRACASRFQLWVALGSFSRTGSVAIWGRVVFATQETCPYDIAVVSLEEDLDDVPIPVPAEHFHEGEAVSVVGFGVFGQSCGPSVTSGILSAVVQVNGTPVMLQTTCAVHSGSSGGPLFSNHSGNLLGIITSNTRDNNTGATYPHLNFSIPITVLQPALQQYSQTQDLGGLRELDRAAEPVRVVWRLQRPLAEAPRSKL

SEQ ID NO: 832971 - protein, 558 aa, Homo sapiens; identical to SEQ ID NO: 832964

SEQ ID NO: 832972 - protein, 408 aa, Homo sapiens
ARCGLWGFSARGRGTGKMAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 832973 - protein, 179 aa, Homo sapiens
ARCGLWGFSARGRGTGKMAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKVQDYPCG

SEQ ID NO: 832974 - protein, 226 aa, Homo sapiens
MHIFLPMLTLLSTQRILEPDDFLDDLDDEDYEEDTPKRRGKGKSKGKGVGSARKKLDASILEDRDKPYACDSECLTSGWVDLALDPAPALDMRGGRVVFLPRVLKQTWALVLPADCFRLRPLGGLGPCYMTGGTCMLWERFLPSSGVGLLVGATAGRVGLSTDGLQVSWPQLSQGPRGLTLSFSTSVLFFFLSALPHFCPSTLGAPSPLGFLSRLLCFPAAAAPVS

SEQ ID NO: 832975 - protein, 408 aa, Homo sapiens; identical to SEQ ID NO: 832972

SEQ ID NO: 832976 - protein, 408 aa, Homo sapiens; identical to SEQ ID NO: 832972

SEQ ID NO: 832977 - protein, 422 aa, Homo sapiens
ARCGLWGFSARGRGTGKMAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDNSFKQKHTSKAPQRVCGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 832978 - protein, 349 aa, Homo sapiens
MTICSKTKKNEKSPNNKTRVEKGDITSDTTEIQRIISSYYKQQYTNTLENLKETDTFLDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 832979 - protein, 108 aa, Homo sapiens
MWPPTCSPTYLRLFLSSTSYFIPIFPFFLLSFTNPENLGVVVPACLWQLQAEVAALTTSGPRPSGRKEQHTAPRRACGPVSLCSPLSAFTLLALGPAPGDHRVQTVSS

SEQ ID NO: 832980 - protein, 384 aa, Homo sapiens
ARCGLWGFSARGRGTGKMAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDSECLTSGWVDLALDPAPALDMRGGRVVFLPRVLKQTWALVLPADCFRLRPLGGLGPCYMTGGTCMLWERFLPSSGVGLLVGATAGRVGLSTDGLQVSWPQLSQGPRGLTLSFSTSVLFFFLSALPHFCPSTLGAPSPLGFLSRLLCFPAAAAPVS

SEQ ID NO: 832981 - protein, 247 aa, Homo sapiens
ARCGLWGFSARGRGTGKMAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGNVTGTTGLSTYAIHW

SEQ ID NO: 832982 - protein, 35 aa, Homo sapiens
MRSRVTAREALGRQVSSAVTTPPTGLVGPSGSAAA

SEQ ID NO: 832983 - protein, 408 aa, Homo sapiens; identical to SEQ ID NO: 832972

SEQ ID NO: 832984 - protein, 324 aa, Homo sapiens
ARCGLWGFSARGRGTGKMAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGPVALL

SEQ ID NO: 832985 - protein, 408 aa, Homo sapiens; identical to SEQ ID NO: 832972

SEQ ID NO: 832986 - protein, 161 aa, Homo sapiens
KTSPQPKEPWVQKAPTFSVSPPPPLSPGKLELPPVSGPVERESFHLPEPELLLMWPPTCSPTYLRLFLSSTSYFIPIFPFFLLSFTNPENLGVVVPACLWQLQAEVAALTTSGPRPSGRKEQHTAPRRACGPVSLCSPLSAFTLLALGPAPGDHRVQTVSS

SEQ ID NO: 832987 - protein, 47 aa, Homo sapiens
TYTPDFYLPCSLGEQYYKDAMEQCHNYNARLCAERSVRLPFLDSQTG

SEQ ID NO: 832988 - protein, 474 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 832989 - protein, 474 aa, Homo sapiens; identical to SEQ ID NO: 832988

SEQ ID NO: 832990 - protein, 474 aa, Homo sapiens; identical to SEQ ID NO: 832988

SEQ ID NO: 832991 - protein, 474 aa, Homo sapiens; identical to SEQ ID NO: 832988

SEQ ID NO: 832992 - protein, 434 aa, Homo sapiens [sequence omitted]

SEQ ID NO: 832993 - protein, 376 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGRKRHS

SEQ ID NO: 832994 - protein, 346 aa, Homo sapiens
MFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 832995 - protein, 456 aa, Homo sapiens
KLECELLMQWKGLGLNINQQGAGFHVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 832996 - protein, 390 aa, Homo sapiens
MFSVSSSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 832997 - protein, 203 aa, Homo sapiens
PSPAVDVLPNSVTVLTRSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 832998 - protein, 474 aa, Homo sapiens; identical to SEQ ID NO: 832988

SEQ ID NO: 832999 - protein, 119 aa, Homo sapiens
EEVGRGSRGLASFIAGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 833000 - protein, 108 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSTKSKSLHFQLSFGGRT

SEQ ID NO: 833001 - protein, 474 aa, Homo sapiens; identical to SEQ ID NO: 832988

SEQ ID NO: 833002 - protein, 288 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVIGKHVYCWRGHMLPSAQTLPPSWLGLRRCSRS

SEQ ID NO: 833003 - protein, 519 aa, Homo sapiens
RRPRWSPPLLPKVHPPGCSRRTPNAKAALSSTAPSWPRLSAKGVGMATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 833004 - protein, 297 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDIWMARKLLWFTSGMATCLVSTVYRIGKHVYCWRGHMLPSAQTLPPSWLGLRRCSRS

SEQ ID NO: 833005 - protein, 456 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 833006 - protein, 328 aa, Homo sapiens
RTRGSGRVGRSRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 833007 - protein, 474 aa, Homo sapiens; identical to SEQ ID NO: 832988

SEQ ID NO: 833008 - protein, 474 aa, Homo sapiens; identical to SEQ ID NO: 832988

SEQ ID NO: 833009 - protein, 108 aa, Homo sapiens
LGIEEKGASFPFPSFIHSFILRRSPALLPRLECNGMISAHRNLCLPGSGDSPASASQIAGTTGTYHHAWLIFVFLVEMGVSLCWPGWSRTPDLMIHTPRPPKVLRLQA

SEQ ID NO: 833010 - protein, 269 aa, Homo sapiens
GGRGWWGFWTEPLRVRADPVSGCGGKMAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDRQGTRVSGTLRLWQ

SEQ ID NO: 833011 - protein, 167 aa, Homo sapiens
MGVKRSLQSGGILLSLVANVLMVLSTATNYWTRQQEGHSGLWQECNHGICSSIPCQTTLAVTVACMVLAVGVGVVGMVMGLRIRCDEGESLRGQTTSAFLFLGGLLLLTALIGYTVKNAWKNNVFFSWSYFSGWLALPFSILAGFCFLLADMIMQSTDAISGFPVCL

SEQ ID NO: 833012 - protein, 218 aa, Homo sapiens
MNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 833013 - protein, 346 aa, Homo sapiens
MYLSLWVTINTVNLRNTLSGLRGAVTTVGMIKSDVPGTQEWLDERRRQGDLPLPTNSNPVLSLELCDPGQGPAPFQAVVVLIQPGRGLALRPPPSCLFPPDPTPSPPAGQIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 833014 - protein, 137 aa, Homo sapiens
GGRGWWGFWTEPLRVRADPVSGCGGKMAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVCGDS

SEQ ID NO: 833015 - protein, 176 aa, Homo sapiens
GGRGWWGFWTEPLRVRADPVSGCGGKMAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGISQ

SEQ ID NO: 833016 - protein, 322 aa, Homo sapiens
MVWREEVVDPQAGLLREGGLQVPRSRDLRQEYQGRSVEEAGSSAGGLGVGKAWAHPALVAPGCSLSGMGVKRSLQSGGILLSLVANVLMVLSTATNYWTRQQEGHSGLWQECNHGICSSIPCQTTLAVTVACMVLAVGVGVVGMVMGLRIRCDEGESLRGQTTSAFLFLGGLLLLTALIGYTVKNAWKNNVFFSWSYFSGWLALPFSILAGKLDSGKRVEETAQKTLTPEAPQLPSQETPGTSRGLPNTLTTPADPAETPLEPQTPVPGALPAIRPRAHLPLPAPHPRPPRLLLSAGRHDHAEHRRHQWIPRVSVTAACLGQ

SEQ ID NO: 833017 - protein, 87 aa, Homo sapiens
GGRGWWGFWTEPLRVRADPVSGCGGKMAELRVLVAVKRVIDYAVKIRVKPDRTGVVTDGVKHSMNPFCEIACGGPAPAHGRRQGGDH

SEQ ID NO: 833018 - protein, 281 aa, Homo sapiens
GGRGWWGFWTEPLRVRADPVSGCGGKMAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 833019 - protein, 281 aa, Homo sapiens; identical to SEQ ID NO: 833018

SEQ ID NO: 833020 - protein, 262 aa, Homo sapiens
GGRGWWGFWTEPLRVRADPVSGCGGKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 833021 - protein, 119 aa, Homo sapiens
MTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 833022 - protein, 155 aa, Homo sapiens
GGRGWWGFWTEPLRVRADPVSGCGGKMAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVAKLKEIGRI

SEQ ID NO: 833023 - protein, 180 aa, Homo sapiens
MGVKRSLQSGGILLSLVANVLMVLSTATNYWTRQQEGHSGLWQECNHGICSSIPCQTTLAVTVACMVLAVGVGVVGMVMGLRIRCDEGESLRGQTTSAFLFLGGETADRPRGSPAALPGNPGDLSGTPQHTNDSRRPGRDPLGAPNPSPRGPPGHPPQGPPSSPCSAPPSPQASAFCWQT

SEQ ID NO: 833024 - protein, 234 aa, Homo sapiens
LAVTVACMVLAVGVGVVGMVMGLRIRCDEGESLRGQTTSAFLFLGGETADRPRRAGRGGPWVMEGPGRQGRGLRYSARIRGAGLEEAERGGRGSRQSSEREEQEGAWARGGLRGDRRGLIEGGGSEGAWPGCSPHQAQLAHLAAGRGPGLLLLTALIGYTVKNAWKNNVFFSWSYFSGWLALPFSILAGKLDSGKRVEETAQKTLTPEAPQLPSQETPGTSRGLPNTLTTPADP

SEQ ID NO: 833025 - protein, 198 aa, Homo sapiens
GRSERFERERRGLLPSTGSCEARGTAFSGLPRSQPFAPGPGSPSRSRGTGRQHPLRRVMGPRRRSRKPEAPRRRSPSPTPTPGPSRRGPSLGASSHQHSRRRQGWLKEIRKLQKSTHLLIRKLPFSRLAREICVKFTRGVDFNWQAQALLALQEAAEAFLVHLFEDAYLLTLHAGRVTLFPKDVQLARRIRGLEEGLG

SEQ ID NO: 833026 - protein, 133 aa, Homo sapiens
ARKRSRRRPRVTGPGAANWSEPQRPPTWPGPSTSCSWPGSCLLPAPSTRSRQSASSHQHSRRRQGWLKEIRKLQKSTHLLIRKLPFSRLAAEAFLVHLFEDAYLLTLHAGRVTLFPKDVQLARRIRGLEEGLG

SEQ ID NO: 833027 - protein, 371 aa, Homo sapiens
MAWTKYQLFLAGLMLVTGSINTLSAKWADNFMAEGCGGSKEHSFQHPFLQAVGMFLGEFSCLAAFYLLRCRAAGQSDSSVDPQQPFNPLLFLPPALCDMTGTSLMYVALNMTSASSFQMLRGAVIIFTGLFSVAFLGRRLVLSQWLGILATIAGLVVVGLADLLSKHDSQHKLSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWEAFHALQILGFLILLIGTALYNGLHRPLLGRLSRGRPLAEESEQERLLGGTRTPINDAS

SEQ ID NO: 833028 - protein, 371 aa, Homo sapiens; identical to SEQ ID NO: 833027

SEQ ID NO: 833029 - protein, 371 aa, Homo sapiens; identical to SEQ ID NO: 833027

SEQ ID NO: 833030 - protein, 198 aa, Homo sapiens; identical to SEQ ID NO: 833025

SEQ ID NO: 833031 - protein, 371 aa, Homo sapiens; identical to SEQ ID NO: 833027

SEQ ID NO: 833032 - protein, 110 aa, Homo sapiens
WHCWHAPQEPGNQGQAVVTVPMNYRGPCRGQGLACLVAVAMLSWPPAPVQPCSHLGPSFPTGDLLIIMAQIIVAIQMVLEEKFVYKHNVHPLRAVGTEGVCGHRGLEGVG

SEQ ID NO: 833033 - protein, 172 aa, Homo sapiens
GRSERFERERRGLLPSTGSCEARGTAFSGLPRSQPFAPGPGSPSRSRGTGRQHPLRRVMGPRRRSRKPEAPRRRSPSPTPTPGPSRRGPSLGASSHQHSRRRQGWLKEIRKLQKSTHLLIRKLPFSRLAAEAFLVHLFEDAYLLTLHAGRVTLFPKDVQLARRIRGLEEGLG

SEQ ID NO: 833034 - protein, 198 aa, Homo sapiens; identical to SEQ ID NO: 833025

SEQ ID NO: 833035 - protein, 288 aa, Homo sapiens
MGGQFHGRGLWREQGAQLPASLPPALNMTSASSFQMLRGAVIIFTGLFSVAFLGRRLVLSQWLGILATIAGLVVVGLADLLSKHDSQHKLSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWEAFHALQILGFLILLIGTALYNGLHRPLLGRLSRGRPLAEESEQERLLGGTRTPINDAS

SEQ ID NO: 833036 - protein, 371 aa, Homo sapiens; identical to SEQ ID NO: 833027

SEQ ID NO: 833037 - protein, 78 aa, Homo sapiens
DTQLSPSQYSILDCATTKIATKEKEDYKQDKDPQVVWDSSRLLQLVGGGRVHSTSFESQGPLSFTGPQCLSQEEANGQ

SEQ ID NO: 833038 - protein, 325 aa, Homo sapiens
MDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAREDYVLVAGHYPVWSIAEHGPTHCLVKQLRPLLATYGVTAYLCGHDHNLQYLQDENGVGYVLSGAGNFMDPSKRHQRKVPNGYLRFHYGTEDSLGGFAYVEISSKEMTVTYIEASGKSLFKTRLPRRARP

SEQ ID NO: 833039 - protein, 323 aa, Homo sapiens [sequence omitted]

SEQ ID NO: 833040 - protein, 323 aa, Homo sapiens [sequence omitted]

SEQ ID NO: 833041 - protein, 407 aa, Homo sapiens
LQKHLAELNHQKQLESNKIPELDMTEVVAPFMANIPLLLYPQDGPRSKPQPKDNGDVCQDCIQMVTDIQTAVRTNSTFVQALMDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAREDYVLVAGHYPVWSIAEHGPTHCLVKQLRPLLATYGVTAYLCGHDHNLQYLQDENGVGYVLSGAGNFMDPSKRHQRKVPNGYLRFHYGTEDSLGGFAYVEISSKEMTVTYIEASGKSLFKTRLPRRARP

SEQ ID NO: 833042 - protein, 271 aa, Homo sapiens
APGAFSVSLILTWWEDRHSTDPREEACPICLLQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAREDYVLVAGHYPVWSIAEHGPTHCLVKQLRPLLATYGVTAYLCGHDHNLQYLQDENGVGYVLSGAGNFMDPSKRHQRKVPNGYLRFHYGTEDSLGGFAYVEISSKEMTVTYIEASGKSLFKTRLPRRARP

SEQ ID NO: 833043 - protein, 111 aa, Homo sapiens
MWTALLILQALLLPSLADGATPALRFVAVGDWGGVPNAPFHTAREMANAKEIARTVQILGADFILSLGDNFYFTGVQDINDKRFQETFEDVFSDRSLRQEGETQLMNCGAT

SEQ ID NO: 833044 - protein, 323 aa, Homo sapiens [sequence omitted]

SEQ ID NO: 833045 - protein, 323 aa, Homo sapiens [sequence omitted]

SEQ ID NO: 833046 - protein, 323 aa, Homo sapiens [sequence omitted]

SEQ ID NO: 833047 - protein, 366 aa, Homo sapiens
RTNFSVTETVLKAGVCRIWISQDAVYSEPQLSDSVTAVSSLMDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAREDYVLVAGHYPVWSIAEHGPTHCLVKQLRPLLATYGVTAYLCGHDHNLQYLQDENGVGYVLSGAGNFMDPSKRHQRKVPNGYLRFHYGTEDSLGGFAYVEISSKEMTVTYIEASGKSLFKTRLPRRARP

SEQ ID NO: 833048 - protein, 290 aa, Homo sapiens
GDEIENYSGHTVISLWTQLVLSSDTYAKSRENMRGHQSLCGGASKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEIPGSPGEEMKEGAGGSRIADAKLEQGRRKRKDLKQVEPQNVINPSNEDSDKGTVEQQTRGQTINPCMVKCTEVAQSSRNNTSKTPPRHNRTKPTSE

SEQ ID NO: 833049 - protein, 1873 aa, Homo sapiens
MWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 833050 - protein, 1036 aa, Homo sapiens
YPSLCLPQLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 833051 - protein, 168 aa, Homo sapiens
SSSVRIYVRQTWKSSCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 833052 - protein, 1873 aa, Homo sapiens; identical to SEQ ID NO: 833049

SEQ ID NO: 833053 - protein, 395 aa, Homo sapiens
YPSLCLPQLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRLSTGGAELGEPCPTCGPCPTSTAPALTLPETHP

SEQ ID NO: 833054 - protein, 784 aa, Homo sapiens
MWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSVRWPGQGLGAVSRNGPVILTALGPGVCLFIKGSARA

SEQ ID NO: 833055 - protein, 1873 aa, Homo sapiens; identical to SEQ ID NO: 833049

SEQ ID NO: 833056 - protein, 334 aa, Homo sapiens [sequence omitted]

SEQ ID NO: 833057 - protein, 128 aa, Homo sapiens
RGMQIRLSRGAVNRPRLHSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 833058 - protein, 828 aa, Homo sapiens
MWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAAGTTGHA

SEQ ID NO: 833059 - protein, 186 aa, Homo sapiens
GRGIPLPIQTFLWRQTSAFLRPKLGKQYEASCVSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATVELFVFLFAPLVHRIK

SEQ ID NO: 833060 - protein, 169 aa, Homo sapiens
PRHPPAHPDLPVAANQSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATVELFVFLFAPLVHRIK

SEQ ID NO: 833061 - protein, 104 aa, Homo sapiens
MTVEPNPFQRKVLWRALSPQDNKCLLRATDGKKKISTVVSSKEVNKFQMAYSNLLRANMDGLKKRDKKNKTKKTKAAAAAAAAAPAAAATAATTAATTAATAAQ

SEQ ID NO: 833062 - protein, 104 aa, Homo sapiens; identical to SEQ ID NO: 833061

SEQ ID NO: 833063 - protein, 152 aa, Homo sapiens
MVLLESEQFLTELTRLFQKCRTSGSVYITLKKYDGRTKPIPKKGTVEGFEPAGQQVSVKSYRWEEEDQHCEPREKTQCHLSKGFQEVSSKEVNKFQMAYSNLLRANMDGLKKRDKKNKTKKTKAAAAAAAAAPAAAATAATTAATTAATAAQ

SEQ ID NO: 833064 - protein, 104 aa, Homo sapiens; identical to SEQ ID NO: 833061

SEQ ID NO: 833065 - protein, 104 aa, Homo sapiens; identical to SEQ ID NO: 833061

SEQ ID NO: 833066 - protein, 104 aa, Homo sapiens; identical to SEQ ID NO: 833061

SEQ ID NO: 833067 - protein, 104 aa, Homo sapiens; identical to SEQ ID NO: 833061

SEQ ID NO: 833068 - protein, 104 aa, Homo sapiens; identical to SEQ ID NO: 833061

SEQ ID NO: 833069 - protein, 152 aa, Homo sapiens; identical to SEQ ID NO: 833063

SEQ ID NO: 833070 - protein, 158 aa, Homo sapiens
HKNMSPEEMPETLRGNQISHDLTIAEKVITRGDHHTTQITSQETESFYDQRTLRHPGHDKQVSVKSYRWEEEDQHCEPREKTQCHLSKGFQEVSSKEVNKFQMAYSNLLRANMDGLKKRDKKNKTKKTKAAAAAAAAAPAAAATAATTAATTAATAAQ

SEQ ID NO: 833071 - protein, 108 aa, Homo sapiens
MTVEPNPFQRKVLWRALSPQDNKCLLRATDGKKKISTVVSSKEVNKFQMAYSNLLRANMDGLKKRDKKNKTKKTKAAAAAAAAAPAQQQQQQQQQQHSKGHTFPAFTN

SEQ ID NO: 833072 - protein, 78 aa, Homo sapiens
DMRKLLRKISTVVSSKEVNKFQMAYSNLLRANMDGLKKRDKKNKTKKTKAAAAAAAAAPAAAATAATTAATTAATAAQ

SEQ ID NO: 833073 - protein, 108 aa, Homo sapiens; identical to SEQ ID NO: 833071

SEQ ID NO: 833074 - protein, 104 aa, Homo sapiens; identical to SEQ ID NO: 833061

SEQ ID NO: 833075 - protein, 104 aa, Homo sapiens; identical to SEQ ID NO: 833061

SEQ ID NO: 833076 - protein, 82 aa, Homo sapiens
IRLGTRLGLNRPRRELVSSKEVNKFQMAYSNLLRANMDGLKKRDKKNKTKKTKAAAAAAAAAPAAAATAATTAATTAATAAQ

SEQ ID NO: 833077 - protein, 104 aa, Homo sapiens; identical to SEQ ID NO: 833061

SEQ ID NO: 833078 - protein, 78 aa, Homo sapiens; identical to SEQ ID NO: 833072

SEQ ID NO: 833079 - protein, 110 aa, Homo sapiens
MHFFLQMTVEPNPFQRKVLWRALSPQDNKCLLRATDGKKKISTVVSSKEVNKFQMAYSNLLRANMDGLKKRDKKNKTKKTKAAAAAAAAAPAAAATAATTAATTAATAAQ

SEQ ID NO: 833080 - protein, 68 aa, Homo sapiens
SDLGSAVSLFFRWAYSNLLRANMDGLKKRDKKNKTKKTKAAAAAAAAAPAAAATAATTAATTAATAAQ

SEQ ID NO: 833081 - protein, 104 aa, Homo sapiens; identical to SEQ ID NO: 833061

SEQ ID NO: 833082 - protein, 106 aa, Homo sapiens
MTVEPNPFQRKVLWRALSPQDNKCLLRATDGKKKISTVVSSKEVNKFQMAYSNLLRANMDGLKKRDKKNKTKKTKAAAQQQQQQQQQQQQQQQQHSKGHTFPAFTN

SEQ ID NO: 833083 - protein, 148 aa, Homo sapiens
MVLLESEQFLTELTRLFQKCRTSGSVYITLKKYDGRTKPIPKKGTVEGFEPAGQQVSVKSYRWEEEDQHCDDLVDETPRQVNTRFRWAYCNTFLRANSGVGYDMKKMTNIEELNSKEGPTYAWKPSQVTRWSEAPCRHVSNKQANIPM

SEQ ID NO: 833084 - protein, 194 aa, Homo sapiens
MKIWTSEHVFDHPWETVTTAAMQKYPNPMNPSVVGVDVLDRHIDPSGKLHSHRLLSTEWGLPSIVKSLIGAARTKTYVQEHSVVDPVEKTMELKSTNISFTNMVSVDERLIYKPHPQDPEKTVLTQEAIITVKGVSLSSYLEGLMASTISSNASKGREAMEWVIHKLNAEIEELTASARGTIRTPMAAAAFAEK

SEQ ID NO: 833085 - protein, 194 aa, Homo sapiens; identical to SEQ ID NO: 833084

SEQ ID NO: 833086 - protein, 194 aa, Homo sapiens; identical to SEQ ID NO: 833084

SEQ ID NO: 833087 - protein, 194 aa, Homo sapiens; identical to SEQ ID NO: 833084

SEQ ID NO: 833088 - protein, 194 aa, Homo sapiens; identical to SEQ ID NO: 833084

SEQ ID NO: 833089 - protein, 194 aa, Homo sapiens; identical to SEQ ID NO: 833084

SEQ ID NO: 833090 - protein, 164 aa, Homo sapiens
MKIWTSEHVFDHPWETVTTAAMQKYPNPMNPSVVGVDVLDRHIDPSGKLHSHRLLSTEWGLPSIVKSISFTNMVSVDERLIYKPHPQDPEKTVLTQEAIITVKGVSLSSYLEGLMASTISSNASKGREAMEWVIHKLNAEIEELTASARGTIRTPMAAAAFAEK

SEQ ID NO: 833091 - protein, 194 aa, Homo sapiens; identical to SEQ ID NO: 833084

SEQ ID NO: 833092 - protein, 176 aa, Homo sapiens
MKIWTSEHVFDHPWETVTTAAMQKYPNPMNPSVVGVDVLDRHIDPSGKLHSHRLLSTEWGLPSIVKSLIGAARTKTYVQEHSVVDPVEKTMELKSTNISFTNMVSVDERLIYKPHPQDPENYLEGLMASTISSNASKGREAMEWVIHKLNAEIEELTASARGTIRTPMAAAAFAEK

SEQ ID NO: 833093 - protein, 194 aa, Homo sapiens; identical to SEQ ID NO: 833084

SEQ ID NO: 833094 - protein, 95 aa, Homo sapiens
GLLSLDVVSEVSFVVLVVCYFGPMWNIPSGETRHILTTNRVLRTDDGHDRGENAEYFVCINIRVSVTYRHMPDRHYAGIWGRWGRTSIMVGGGLA

SEQ ID NO: 833095 - protein, 194 aa, Homo sapiens; identical to SEQ ID NO: 833084

SEQ ID NO: 833096 - protein, 104 aa, Homo sapiens
MELKSTNISFTNMVSVDERLIYKPHPQDPEKTVLTQEAIITVKGVSLSSYLEGLMASTISSNASKGREAMEWVIHKLNAEIEELTASARGTIRTPMAAAAFAEK

SEQ ID NO: 833097 - protein, 179 aa, Homo sapiens
MKIWTSEHVFDHPWETVTTAAMQKYPNPMNPSVVGVDVLDRHIDPSGKLHSHRLLSTEWGLPSIVKSLIGAARTKTYVQEHSVVDPVEKTMELKSTNKPHPQDPEKTVLTQEAIITVKGVSLSSYLEGLMASTISSNASKGREAMEWVIHKLNAEIEELTASARGTIRTPMAAAAFAEK

SEQ ID NO: 833098 - protein, 184 aa, Homo sapiens
MKIWTSEHVFDHPWETVTTAAMQKYPNPMNPSVVGVDVLDRHIDPSGKLHSHRLLSTEWGLPSIVKSLIGAARTKTYVQEHSVVDPVEKTMELKSTNISFTNMVSVDERLIYKPHPQDPEKTVLTQEAIITVKGVSLSSYLEGLMGREAMEWVIHKLNAEIEELTASARGTIRTPMAAAAFAEK

SEQ ID NO: 833099 - protein, 194 aa, Homo sapiens; identical to SEQ ID NO: 833084

SEQ ID NO: 833100 - protein, 131 aa, Homo sapiens
FTVRVRDLGLRMRSRVLWGAARWLWPRRAVGPARRPLSSGSPPLEELFARGGPLRTFLERQAGSEAHLKVRRPELLAVIKLLNEKEQELRETEHLLHDENEDLRKLAENEITLCQKEITQLKHQVWYFCKE

SEQ ID NO: 833101 - protein, 238 aa, Homo sapiens
MLFTSEIFDMYQQYAAFKRWHFETLEYFPSELGGLRHASASIGGSEAYRHMKFEGGVHRVQRVPKTEKQGRVHTSTMTVAILPQPTEINLVINPKDLRIDTKRASGAGGQHVNTTDSAVRIVHLPTGVVSECQQERSQLKNKELAMTKLRAKLYSMHLEEEINKRQNARKIQIGSKGRSEKIRTYNFPQNRVTDHRINKTLHDLETFMQGDYLLDELVQSLKEYADYESLVEIISQKV

SEQ ID NO: 833102 - protein, 282 aa, Homo sapiens
FTVRVRDLGLRMRSRVLWGAARWLWPRRAVGPARRPLSSGSPPLEELFARGGPLRTFLERQAGSEAHLKVRRPELLAVIKLLNEKEQELRETEHLLHDENEDLRKLAENEITLCQKEITQLKHQIILLLVPSEETDENDLILEVTAGVGGQEAMLFTSEIFDMYQQYAAFKRWHFETLEYFPSELGGLRHASASIGGSEAYRHMKFEGGVHRVQRVPKTEKQGRVHTSTMTVAILPQPTEINLVINPKDLRIDTKRASGAGGQHVNTTDSAVRIVHLPTDWK

SEQ ID NO: 833103 - protein, 246 aa, Homo sapiens
FTVRVRDLGLRMRSRVLWGAARWLWPRRAVGPARRPLSSGSPPLEELFARGGPLRTFLERQAGSEAHLKVRRPELLAVIKLLNEKEQELRETEHLLHDENEDLRKLAENEITLCQKEITQLKHQIILLLVPSEETDENDLILEVTAGVGGGLRHASASIGGSEAYRHMKFEGGVHRVQRVPKTEKQGRVHTSTMTVAILPQPTEINLVINPKDLRIDTKRASGAGGQHVNTTDSAVRIVHLPTDWK

SEQ ID NO: 833104 - protein, 259 aa, Homo sapiens
FTVRVRDLGLRMRSRVLWGAARWLWPRRAVGPARRPLSSGSPPLEELFARGGPLRTFLERQAGSEAHLKVRRPELLAVIKLLNEKEQELRETEHLLHDENEDLRKLAENEITLCQKEITQLKHQIILLLVPSEETDENDLILEVTAGVGGQEAMLFTSEIFDMYQQYAAFKRWHFETLEYFPSELGGLRHASASIGGSEAYRHMKFEGGVHRVQRVPKTEKQGRVHTSTMTVAILPQPTEINLVINPKDLRIDTKSSSA

SEQ ID NO: 833105 - protein, 111 aa, Homo sapiens
FTVRVRDLGLRMRSRVLWGAARWLWPRRAVGPARRPLSSGSPPLEELFARGGPLRTFLERQAGSEAHLKVRRPELLAVIKLLNEKEQELRETEHLLHGKGRARGRGVRAHS

SEQ ID NO: 833106 - protein, 391 aa, Homo sapiens
FTVRVRDLGLRMRSRVLWGAARWLWPRRAVGPARRPLSSGSPPLEELFARGGPLRTFLERQAGSEAHLKVRRPELLAVIKLLNEKEQELRETEHLLHDENEDLRKLAENEITLCQKEITQLKHQIILLLVPSEETDENDLILEVTAGVGGQEAMLFTSEIFDMYQQYAAFKRWHFETLEYFPSELGGLRHASASIGGSEAYRHMKFEGGVHRVQRVPKTEKQGRVHTSTMTVAILPQPTEINLVINPKDLRIDTKRASGAGGQHVNTTDSAVRIVHLPTGVVSECQQERSQLKNKELAMTKLRAKLYSMHLEEEINKRQNARKIQIGSKGRSEKIRTYNFPQNRVTDHRINKTLHDLETFMQGDYLLDELVQSLKEYADYESLVEIISQKV

SEQ ID NO: 833107 - protein, 355 aa, Homo sapiens
FTVRVRDLGLRMRSRVLWGAARWLWPRRAVGPARRPLSSGSPPLEELFARGGPLRTFLERQAGSEAHLKVRRPELLAVIKLLNEKEQELRETEHLLHDENEDLRKLAENEITLCQKEITQLKHQIILLLVPSEETDENDLILEVTAGVGGGLRHASASIGGSEAYRHMKFEGGVHRVQRVPKTEKQGRVHTSTMTVAILPQPTEINLVINPKDLRIDTKRASGAGGQHVNTTDSAVRIVHLPTGVVSECQQERSQLKNKELAMTKLRAKLYSMHLEEEINKRQNARKIQIGSKGRSEKIRTYNFPQNRVTDHRINKTLHDLETFMQGDYLLDELVQSLKEYADYESLVEIISQKV

SEQ ID NO: 833108 - protein, 131 aa, Homo sapiens
FTVRVRDLGLRMRSRVLWGAARWLWPRRAVGPARRPLSSGSPPLEELFARGGPLRTFLERQAGSEAHLKVRRPELLAVIKLLNEKEQELRETEHLLHDENEDLRKLAENEITLCQKEITQLKHQKKQMKMI

SEQ ID NO: 833109 - protein, 177 aa, Homo sapiens
AYNVSNTAVSYINDSLTVAILPQPTEINLVINPKDLRIDTKRASGAGGQHVNTTDSAVRIVHLPTGVVSECQQERSQLKNKELAMTKLRAKLYSMHLEEEINKRQNARKIQIGSKGRSEKIRTYNFPQNRVTDHRINKTLHDLETFMQGDYLLDELVQSLKEYADYESLVEIISQKV

SEQ ID NO: 833110 - protein, 391 aa, Homo sapiens; identical to SEQ ID NO: 833106

SEQ ID NO: 833111 - protein, 263 aa, Homo sapiens
SAIPVWMATYMAGTLKVSNMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 833112 - protein, 337 aa, Homo sapiens
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANRDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 833113 - protein, 377 aa, Homo sapiens
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 833114 - protein, 264 aa, Homo sapiens
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRSPSDPS

SEQ ID NO: 833115 - protein, 173 aa, Homo sapiens
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYERSLS

SEQ ID NO: 833116 - protein, 69 aa, Homo sapiens
MPVSHTAPRAAPPPPVRDALSHGSTNTLRAASTRLGGRSTPTKLEVLSEPDGRPNRSRGDPPRSRPTDP

SEQ ID NO: 833117 - protein, 377 aa, Homo sapiens; identical to SEQ ID NO: 833113

SEQ ID NO: 833118 - protein, 377 aa, Homo sapiens; identical to SEQ ID NO: 833113

SEQ ID NO: 833119 - protein, 295 aa, Homo sapiens
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIPRVR

SEQ ID NO: 833120 - protein, 266 aa, Homo sapiens
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGHVHGRDILGVQRGLCEQGG

SEQ ID NO: 833121 - protein, 98 aa, Homo sapiens
RLLLLLNSRPRRQGVLLITMNVLLGSVVIFATFVTLCNASCYFIPNEGVPGDSTRKCMDLKGNKHPINSEWQTDNCETCTVLRNRNFMLHPCFYTCGL

SEQ ID NO: 833122 - protein, 114 aa, Homo sapiens
MNVLLGSVVIFATFVTLCNASCYFIPNEGVPGDSTRKCMDLKGNKHPINSEWQTDNCETCTCYETEISCCTLVSTPVGYDKDNCQRIFKKEDCKYIVVEKKDPKKTCSVSEWII

SEQ ID NO: 833123 - protein, 114 aa, Homo sapiens; identical to SEQ ID NO: 833122

SEQ ID NO: 833124 - protein, 95 aa, Homo sapiens
AYYYSPGGGRVDLLITMNVLLGSVVIFATFVTLCNASCYFIPNEGVPGDSTRKCMDLKGNKHPINSEWQTDNCETCTVLRNRNFMLHPCFYTCGL

SEQ ID NO: 833125 - protein, 49 aa, Homo sapiens
MGQGAKGGPEENPGNRRGGSPHKKPREPRRPSRVRDTAYTGHSEIAAEG

SEQ ID NO: 833126 - protein, 116 aa, Homo sapiens
RLKGEKLVVPARARSGIPGVDKLLNFRPGRQGVLLITMNVLLGSVVIFATFVTLCNASCYFIPNEGVPGDSTRKCMDLKGNKHPINSEWQTDNCETCTVLRNRNFMLHPCFYTCGL

SEQ ID NO: 833127 - protein, 114 aa, Homo sapiens; identical to SEQ ID NO: 833122

SEQ ID NO: 833128 - protein, 114 aa, Homo sapiens; identical to SEQ ID NO: 833122

SEQ ID NO: 833129 - protein, 94 aa, Homo sapiens
RRLLLLNSRPRRQGVLLITMNVLLGSVVIFATFVTLCNASCYFIPNEGVPGDSTRMFLHLWVMTKTTAKESSRRRTASISWWRRRTQKKTCSGQ

SEQ ID NO: 833130 - protein, 116 aa, Homo sapiens; identical to SEQ ID NO: 833126

SEQ ID NO: 833131 - protein, 94 aa, Homo sapiens; identical to SEQ ID NO: 833129

SEQ ID NO: 833132 - protein, 117 aa, Homo sapiens
MNVLLGSVVIFATFVTLCNASCYFIPNEGVPGDSTRKCMDLKGNKHPINSEWQTDNCETCTVLRNRNFMLHPCFYNLVGGFNLDQKGNKSWPKSNSFKKGRTGKVYSCVEKKDPKKD

SEQ ID NO: 833133 - protein, 79 aa, Homo sapiens
GTFYYRTSVLITSDMFFRVTVVESFVGKPFFFRLGKPFFFKTLGPQKIGAIFNAISYLMREFQEIQPGNAWISKETNTQ

SEQ ID NO: 833134 - protein, 114 aa, Homo sapiens; identical to SEQ ID NO: 833122

SEQ ID NO: 833135 - protein, 114 aa, Homo sapiens; identical to SEQ ID NO: 833122

SEQ ID NO: 833136 - protein, 114 aa, Homo sapiens; identical to SEQ ID NO: 833122

SEQ ID NO: 833137 - protein, 118 aa, Homo sapiens
KCPVQDFFLLHLPLGLTLDLGGLGFRERLQGPGRCSVLPWCSSWLVLGMAFPPGWLLYKHLQSHLVPVPWSEPDICAHPKASPALPSSKTHQCPSLPCVKIFGFSVETIQGAASSPAS

SEQ ID NO: 833138 - protein, 106 aa, Homo sapiens
HFPSPRGGSGVASLERAESSSTEPAKAIKPIDRKSVHQICSGPVVLSLSTAVKKIVGNSLDAGATNIDLKLKDYGMDLIEVSGNGCGVEEENFEGLISFSSETSHI

SEQ ID NO: 833139 - protein, 122 aa, Homo sapiens
MGGTWPRRVGGRLVEAPERHPQRPSDPVPIRCALKPSTEPAKAIKPIDRKSVHQICSGPVVLSLSTAVKKIVGNSLDAGATNIDLKLKDYGMDLIEVSGNGCGVEEENFEGLISFSSETSHI

SEQ ID NO: 833140 - protein, 32 aa, Homo sapiens
MVQVLLDDLHQWFLSSFLMSAISIGIKFLLKI

SEQ ID NO: 833141 - protein, 106 aa, Homo sapiens; identical to SEQ ID NO: 833138

SEQ ID NO: 833142 - protein, 113 aa, Homo sapiens
CRGFLQRIKTARGPRTASPTGTMKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 833143 - protein, 113 aa, Homo sapiens; identical to SEQ ID NO: 833142

SEQ ID NO: 833144 - protein, 113 aa, Homo sapiens; identical to SEQ ID NO: 833142

SEQ ID NO: 833145 - protein, 113 aa, Homo sapiens; identical to SEQ ID NO: 833142

SEQ ID NO: 833146 - protein, 273 aa, Homo sapiens
MLKPALEPRGGFSFENCQRNASLERVLPGLKVPHARKTGTTIAGLVFQDGVILGADTRATNDSVVADKSCEKIHFIAPKIYCCGAGVAADAEMTTRMVASKMELHALSTGREPRVATVTRILRQTLFRYQGHVGASLIVGGVDLTGPQLYGVHPHGSYSRLPFTALGSGQDAALAVLEDRFQPNMTLEAAQGLLVEAVTAGILGDLGSGGNVDACVITKTGAKLLRTLSSPTEPVKRSGRYHFVPGTTAVLTQTVKPLTLELVEETVQAMEVE

SEQ ID NO: 833147 - protein, 113 aa, Homo sapiens
MLLLPSGSGQDAALAVLEDRFQPNMTLEAAQGLLVEAVTAGILGDLGSGGNVDACVITKTGAKLLRTLSSPTEPVKRSGRYHFVPGTTAVLTQTVKPLTLELVEETVQAMEVE

SEQ ID NO: 833148 - protein, 115 aa, Homo sapiens
MCTRELGEHRTLAQCGWLRLVGGGDHRRLEAAQGLLVEAVTAGILGDLGSGGNVDACVITKTGAKLLRTLSSPTEPVKRSGRYHFVPGTTAVLTQTVKPLTLELVEETVQAMEVE

SEQ ID NO: 833149 - protein, 159 aa, Homo sapiens
MAPACGRPRPSSSRYQGHVGASLIVGGVDLTGPQLYGVHPHGSYSRLPFTALGSGQDAALAVLEDRFQPNMTLEAAQGLLVEAVTAGILGDLGSGGNVDACVITKTGAKLLRTLSSPTEPVKRSGRYHFVPGTTAVLTQTVKPLTLELVEETVQAMEVE

SEQ ID NO: 833150 - protein, 273 aa, Homo sapiens; identical to SEQ ID NO: 833146

SEQ ID NO: 833151 - protein, 273 aa, Homo sapiens; identical to SEQ ID NO: 833146

SEQ ID NO: 833152 - protein, 310 aa, Homo sapiens
MLKPALEPRGGFSFENCQRNASLERVLPGLKVPHARKTGTTIAGLVFQDGVILGADTRATNDSVVADKSCEKIHFIAPKIYVRLPSPVPVRKKERPPRSHSGPRTSQPCHTDPPFCLSCCGAGVAADAEMTTRMVASKMELHALSTGREPRVATVTRILRQTLFRYQGHVGASLIVGGVDLTGPQLYGVHPHGSYSRLPFTALGSGQDAALAVLEDRFQPNMTLEAAQGLLVEAVTAGILGDLGSGGNVDACVITKTGAKLLRTLSSPTEPVKRSGRYHFVPGTTAVLTQTVKPLTLELVEETVQAMEVE

SEQ ID NO: 833153 - protein, 223 aa, Homo sapiens [sequence omitted]

SEQ ID NO: 833154 - protein, 187 aa, Homo sapiens
MLKPALEPRGGFSFENCQRNASLERVLPGLKVPHARKTGTTIAGLVFQDGVILGADTRATNDSVVADKSCEKIHFIAPKIYCCGAGVAADAKSFSLNLGKDDNNLCLHFNPRFEAHGDINTIVCNSKDGGAWGAEQRESAFPFQPGSVAEVCVFHETDLTIKLPDGYESVPQPAQPWMASTTGCSGD

SEQ ID NO: 833155 - protein, 159 aa, Homo sapiens; identical to SEQ ID NO: 833149

SEQ ID NO: 833156 - protein, 159 aa, Homo sapiens; identical to SEQ ID NO: 833149

SEQ ID NO: 833157 - protein, 273 aa, Homo sapiens; identical to SEQ ID NO: 833146

SEQ ID NO: 833158 - protein, 299 aa, Homo sapiens
EQVSNTHAVIVSRTSWLWGAEMGSNEHGVCIVNQAGWSNEPIGQRNASLERVLPGLKVPHARKTGTTIAGLVFQDGVILGADTRATNDSVVADKSCEKIHFIAPKIYCCGAGVAADAEMTTRMVASKMELHALSTGREPRVATVTRILRQTLFRYQGHVGASLIVGGVDLTGPQLYGVHPHGSYSRLPFTALGSGQDAALAVLEDRFQPNMTLEAAQGLLVEAVTAGILGDLGSGGNVDACVITKTGAKLLRTLSSPTEPVKRSGRYHFVPGTTAVLTQTVKPLTLELVEETVQAMEVE

SEQ ID NO: 833159 - protein, 258 aa, Homo sapiens
MLKPALEPRGGFSFENCQRNASLERVLPGLKVPHARKTGTTIAGLVFQDGVILGADTRATNDSVVADKSCEKIHFIAPKIYCCGAGVAADAEMTTRMVASKMELHALSTGREPRVATVTRILRQTLFRYQGHVGASLIVGGVDLTGPQLYGVHPHGSYSRLPFTALGSGQDAALAVLEDRFQPNMTLEAAQGLLVEAVTAGILGDLGSGGNVDACVITKTGAKLLRTLSSPTEPVKRGCPSSLPGLAATTLCLEPQLS

SEQ ID NO: 833160 - protein, 223 aa, Homo sapiens [sequence omitted]

SEQ ID NO: 833161 - protein, 246 aa, Homo sapiens
FSCSLAPLVWPTHPPATPNPLCLPQDAEASPGAPRGLLLRELPKVKRGRGGRSLLSRLCLLVAFFPGWGWGRVCWSTWVPGLPRKMRETGTRLGEATGVLKAEPNMGALLRFQKCIIGTRPPGAQGPSRTQDRDHHRGPGVPSEQRGGTGSWRGAESIEQALKLRSLPLLRTGSFWAPIREPLTIRSWRTRAARRSTSSPPKSSETPEPSSRTQKRTAPSFPLRSPHVPALPTPILPFASAAVGLE

SEQ ID NO: 833162 - protein, 113 aa, Homo sapiens
MKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 833163 - protein, 113 aa, Homo sapiens; identical to SEQ ID NO: 833162

SEQ ID NO: 833164 - protein, 113 aa, Homo sapiens; identical to SEQ ID NO: 833162

SEQ ID NO: 833165 - protein, 1274 aa, Homo sapiens
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 833166 - protein, 1274 aa, Homo sapiens; identical to SEQ ID NO: 833165

SEQ ID NO: 833167 - protein, 1216 aa, Homo sapiens
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 833168 - protein, 1187 aa, Homo sapiens
MRSSHSKQTSQSNKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 833169 - protein, 1009 aa, Homo sapiens
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEALLEEIERHGKKVEECQRFAKQYTCRWSTT

SEQ ID NO: 833170 - protein, 552 aa, Homo sapiens
VGLLHVRSFTPHQQAHIPNSIMTILEASGKQEPEAKEAPAGPLEEDDLEPLTLAQVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 833171 - protein, 475 aa, Homo sapiens
SHRGVARRRTAQPGLGAGAGPCLEELQGDAKIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 833172 - protein, 316 aa, Homo sapiens
MKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 833173 - protein, 241 aa, Homo sapiens
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNGRWRGGAAECRKRHC

SEQ ID NO: 833174 - protein, 62 aa, Homo sapiens
MRPHCLPPPFLPPAAGEGNSALSPLNPGELLIALHNIDSVKCDMKSIIKGEALPPHSSGLAP

SEQ ID NO: 833175 - protein, 1274 aa, Homo sapiens; identical to SEQ ID NO: 833165

SEQ ID NO: 833176 - protein, 1222 aa, Homo sapiens
PISFQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 833177 - protein, 887 aa, Homo sapiens
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVDPTLPRAGEAGPGSLPQATARRPLPHPGAQWAGEERGDPGPA

SEQ ID NO: 833178 - protein, 899 aa, Homo sapiens
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPVRPLSPPGPAHPRARLCPQLQLFPNLLHLRVCQARRVVTPGRPRLCSLQAVRMSLLRKRQVARQLGAWS

SEQ ID NO: 833179 - protein, 441 aa, Homo sapiens
MGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 833180 - protein, 662 aa, Homo sapiens
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDG

SEQ ID NO: 833181 - protein, 96 aa, Homo sapiens
PNLGEDDEDKDLEPGPSGTSKASAQISGQSDTDITAEFLQPLLTPDNVANLVRMGGERFPPGQEGRISSVFHLPPLHTIHLLQSTLLINKEKGFNW

SEQ ID NO: 833182 - protein, 74 aa, Homo sapiens
FAERNVYTSEVLAVVMQQLMEQSPLPMLLMRTVIQSLTMYPRLGGFVMNILSRLIMKQVTHPRPPRLQAADSSF

SEQ ID NO: 833183 - protein, 79 aa, Homo sapiens
MSILYFHPFSRDLHSKLSPLDPQVTMEEEDESRGKTEESGEDRGDGPPDRDPTLSPSAFILRAIQQLWTCSGQICRDPL

SEQ ID NO: 833184 - protein, 1064 aa, Homo sapiens
MEEEDESRGKTEESGEDRGDGPPDRDPTLSPSAFILRAIQQAVGSSLQGDLPNDKDGSRCHGLRWRRCRSPRSEPRSQESGGTDTATVLDMATDSFLAGLVSVLDPPDTWVPSRLDLRPGESEDMLELVAEVRIGDRDPIPLPVPSLLPRLRAWRTGKTVSPQSNSSRPTCARHLTLGTGDGGPAPPPAPSSASSSPSPSPSSSSPSPPPPPPPPAPPAPPAPRFDIYDPFHPTDEAYSPPPAPEQKYDPFEPTGSNPSSSAGTPSPEEEEEEEEEEEEEEEDEEEEEGLSQSISRISETLAGIYDDNSLSQDFPGDESPRPDAQPTQPTPAPGTPPQVDSTRADGAMRRRVFVVGTEAEACREGKVSVEVVTAGGAALPPPLLPPGDSEIEEGEIVQPEEEPRLALSLFRPGGRAARPTPAASATPTAQPLPQPPAPRAPEGDDFLSLHAESDGEGALQVDLGEPAPAPPAADSRWGGLDLRRKILTQRRERYRQRSPSPAPAPAPAAAAGPPTRKKSRRERKRSGEAKEAASSSSGTQPAPPAPASPWDSKKHRSRDRKPGSHASSSARRRSRSRSRSRSTRRRSRSTDRRRGGSRRSRSREKRRRRRRSASPPPATSSSSSSRRERHRGKHRDGGGSKKKKKRSRSRGEKRSGDGSEKAPAPAPPPSGSTSCGDRDSRRRGAVPPSIQDLTDHDLFAIKRTITVGRLDKSDPRGPSPAPASSPKREVLYDSEGLSGEERGGKSSQKDRRRSGAASSSSSSREKGSRRKALDGGDRDRDRDRDRDRDRSSKKARPPKESAPSSGPPPKPPVSSGSGSSSSSSSCSSRKVKLQSKVAVLIREGVSSTTPAKDAASAGLGSIGVKFSRDRESRSPFLKPDERAPTEMAKAAPGSTMPWNLPAGVDCTTSGVLALTALLFKMEEANLASRAKAQELIQATNQISAQKSTSVLGMTQFRGHSGGWARAPKPVGRPLGGLRWTPNPRVRHREHKEEAALRPGEPNDLRKERKEEEERRDNDTYRKDTEEDTHGHQPNRRNPSQRRPRTRRTDPHQARATRNQHEQLD

SEQ ID NO: 833185 - protein, 147 aa, Homo sapiens
MGDGEEVSLGGEEGDRIFSRPPGPVPLALGHPSSRGTEGLWPGYWGSSSYRSSKLRPTVLGGWGPGSLVVTPTVPGPPDLPQQKWGNQPSEGEQPGAGLRPALPLLPQARSQARGPPRAPTAAQGARAPRQGWPGPAPAPSLRALAS

SEQ ID NO: 833186 - protein, 1312 aa, Homo sapiens
MEEEDESRGKTEESGEDRGDGPPDRDPTLSPSAFILRAIQQAVGSSLQGDLPNDKDGSRCHGLRWRRCRSPRSEPRSQESGGTDTATVLDMATDSFLAGLVSVLDPPDTWVPSRLDLRPGESEDMLELVAEVRIGDRDPIPLPVPSLLPRLRAWRTGKTVSPQSNSSRPTCARHLTLGTGDGGPAPPPAPSSASSSPSPSPSSSSPSPPPPPPPPAPPAPPAPRFDIYDPFHPTDEAYSPPPAPEQKYDPFEPTGSNPSSSAGTPSPEEEEEEEEEEEEEEEDEEEEEGLSQSISRISETLAGIYDDNSLSQDFPGDESPRPDAQPTQPTPAPGTPPQVDSTRADGAMRRRVFVVGTEAEACREGKVSVEVVTAGGAALPPPLLPPGDSEIEEGEIVQPEEEPRLALSLFRPGGRAARPTPAASATPTAQPLPQPPAPRAPEGDDFLSLHAESDGEGALQVDLGEPAPAPPAADSRWGGLDLRRKILTQRRERYRQRSPSPAPAPAPAAAAGPPTRKKSRRERKRSGEAKEAASSSSGTQPAPPAPASPWDSKKHRSRDRKPGSHASSSARRRSRSRSRSRSTRRRSRSTDRRRGGSRRSRSREKRRRRRRSASPPPATSSSSSSRRERHRGKHRDGGGSKKKKKRSRSRGEKRSGDGSEKAPAPAPPPSGSTSCGDRDSRRRGAVPPSIQDLTDHDLFAIKRTITVGRLDKSDPRGPSPAPASSPKREVLYDSEGLSGEERGGKSSQKDRRRSGAASSSSSSREKGSRRKALDGGDRDRDRDRDRDRDRSSKKARPPKESAPSSGPPPKPPVSSGSGSSSSSSSCSSRKVKLQSKVAVLIREGVSSTTPAKDAASAGLGSIGVKFSRDRESRSPFLKPDERAPTEMAKAAPGSTKPKKTKVKAKAGAKKTKGTKGKTKPSKTRKKVRSGGGSGGSGGQVSLKKSKADSCSQAAGTKGAEETSWSGEERAAKVPSTPPPKAAPPPPALTPDSQTVDSSCKTPEVSFLPEEATEEAGVRGGAEEEEEEEEEEEEEEEEEEQQPATTTATSTAAAAPSTAPSAGSTAGDSGAEDGPASRVSQLPTLPPPMPWNLPAGVDCTTSGVLALTALLFKMEEANLASRAKAQELIQATNQILSHRKPPSSLGMTPAPVPTSLGLPPGPSSYLLPGSLPLGGCGSTPPTPTGLAATSDKREGSSSSEGRGDTDKYLKKLHTQERAVEEVKLAIKPYYQKKDITKEEYKDILRKAVHKICHSKSGEINPVKVSNLVRAYVQRYRYFRKHGRKPGDPPGPPRPPKEPGPPDKGGPGLPLPPL

SEQ ID NO: 833187 - protein, 1337 aa, Homo sapiens
MSILYFHPFSRDLHSKLSPLDPQVTMEEEDESRGKTEESGEDRGDGPPDRDPTLSPSAFILRAIQQAVGSSLQGDLPNDKDGSRCHGLRWRRCRSPRSEPRSQESGGTDTATVLDMATDSFLAGLVSVLDPPDTWVPSRLDLRPGESEDMLELVAEVRIGDRDPIPLPVPSLLPRLRAWRTGKTVSPQSNSSRPTCARHLTLGTGDGGPAPPPAPSSASSSPSPSPSSSSPSPPPPPPPPAPPAPPAPRFDIYDPFHPTDEAYSPPPAPEQKYDPFEPTGSNPSSSAGTPSPEEEEEEEEEEEEEEEDEEEEEGLSQSISRISETLAGIYDDNSLSQDFPGDESPRPDAQPTQPTPAPGTPPQVDSTRADGAMRRRVFVVGTEAEACREGKVSVEVVTAGGAALPPPLLPPGDSEIEEGEIVQPEEEPRLALSLFRPGGRAARPTPAASATPTAQPLPQPPAPRAPEGDDFLSLHAESDGEGALQVDLGEPAPAPPAADSRWGGLDLRRKILTQRRERYRQRSPSPAPAPAPAAAAGPPTRKKSRRERKRSGEAKEAASSSSGTQPAPPAPASPWDSKKHRSRDRKPGSHASSSARRRSRSRSRSRSTRRRSRSTDRRRGGSRRSRSREKRRRRRRSASPPPATSSSSSSRRERHRGKHRDGGGSKKKKKRSRSRGEKRSGDGSEKAPAPAPPPSGSTSCGDRDSRRRGAVPPSIQDLTDHDLFAIKRTITVGRLDKSDPRGPSPAPASSPKREVLYDSEGLSGEERGGKSSQKDRRRSGAASSSSSSREKGSRRKALDGGDRDRDRDRDRDRDRSSKKARPPKESAPSSGPPPKPPVSSGSGSSSSSSSCSSRKVKLQSKVAVLIREGVSSTTPAKDAASAGLGSIGVKFSRDRESRSPFLKPDERAPTEMAKAAPGSTKPKKTKVKAKAGAKKTKGTKGKTKPSKTRKKVRSGGGSGGSGGQVSLKKSKADSCSQAAGTKGAEETSWSGEERAAKVPSTPPPKAAPPPPALTPDSQTVDSSCKTPEVSFLPEEATEEAGVRGGAEEEEEEEEEEEEEEEEEEQQPATTTATSTAAAAPSTAPSAGSTAGDSGAEDGPASRVSQLPTLPPPMPWNLPAGVDCTTSGVLALTALLFKMEEANLASRAKAQELIQATNQILSHRKPPSSLGMTPAPVPTSLGLPPGPSSYLLPGSLPLGGCGSTPPTPTGLAATSDKREGSSSSEGRGDTDKYLKKLHTQERAVEEVKLAIKPYYQKKDITKEEYKDILRKAVHKICHSKSGEINPVKVSNLVRAYVQRYRYFRKHGRKPGDPPGPPRPPKEPGPPDKGGPGLPLPPL

SEQ ID NO: 833188 - protein, 225 aa, Homo sapiens
MEEEDESRGKTEESGEDRGDGPPDRDPTLSPSAFILRAIQQAVGSSLQGDLPNDKDGSRCHGLRWRRCRSPRSEPRSQESGGTDTATVLDMATDSFLAGLVSVLDPPDTWVPSRLDLRPGESEDMLELVAEVRIGDRDPIPLPVPSLLPRLRAWRTGKTVSPQSNSSRPTCARHLTLGTGDGGPAPPPAPSSASSSPSPSPSSSSPSPPPPPPPPAPPAPPAPRF

SEQ ID NO: 833189 - protein, 111 aa, Homo sapiens
RRSPVVSEPFRALGPGTALVLRNCGQDQGGRHLEVSQGKDHKGLRPETQTDAHKDSPSDSPPTTIHVPQVSVPAREDARLEARKDLNTAPYIPSWLEQIPRQQNCQLHLMG

SEQ ID NO: 833190 - protein, 505 aa, Homo sapiens
GASALARHGGGLAGGVGWDCGACASRCQGVMEGLLTRCRALPALATCSRQLSGYVPCRFHHCAPRRGRRLLLSRVFQPQNLREDRVLSLQDKSDDLTCKSQRLMLQVGLIYPASPGCYHLLPYTVRAMEKLVRVIDQEMQAIGGQKVNMPSLSPAELWQATNRWDLMGKELLRLRDRHGKEYCLGPTHEEAITALIASQKKLSYKQLPFLLYQVTRKFRDEPRPRFGLLRGREFYMKDMYTFDSSPEAAQQTYSLVCDAYCSLFNKLGLPFVKVQADVGTIGGTVSHEFQLPVDIGEDRLAICPRCSFSANMETLDLSQMNCPACQGPLTKTKGIEVGHTFYLGTKYSSIFNAQFTNVCGKPTLAEMGCYGLGVTRILAAAIEVLSTEDCVRWPSLLAPYQACLIPPKKGSKEQAASELIGQLYDHITEAVPQLHGEVLLDDRTHLTIGNRLKDANKFGYPFVIIAGKRALEDPAHFEVWCQNTGEVAFLTKDGVMDLLTPVQTV

SEQ ID NO: 833191 - protein, 1572 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPMPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 833192 - protein, 1658 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKVHFFLHTKSHYVNITQSDFENALFLLNCPKLSYFGKTRTPDLNYPNNLNFMRIYEKHKANITLNGKRLKTFPQDQYKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 833193 - protein, 1282 aa, Homo sapiens
TKLNFSSQPELHTPVFSISDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGMNPRTQNKDSLEDSVSTSPDPMPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 833194 - protein, 1253 aa, Homo sapiens
TKLNFSSQPELHTPVFSISDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYQIVRGRAPVSGKRAGGPHECPRKGVAPGSILFLHHLWDIRGRICHFLPRSVHRCKIIL

SEQ ID NO: 833195 - protein, 1249 aa, Homo sapiens
TKLNFSSQPELHTPVFSISDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHSCKDL

SEQ ID NO: 833196 - protein, 617 aa, Homo sapiens
TKLNFSSQPELHTPVFSISDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRSVSEKKALGLVGEGFGYIPHMHQNTGFVLASATHILKLERYRGD

SEQ ID NO: 833197 - protein, 495 aa, Homo sapiens
TKLNFSSQPELHTPVFSISDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGNQSKR

SEQ ID NO: 833198 - protein, 130 aa, Homo sapiens
PSPGPPSHTCHGDHMYLFPLLREAVLTLSAPPVVPGFCCTVGVDWKSLTTPACLPLTTDYFPDRQGLQNDYTEGCYDLLPEADIDRSVSEKKALGLVGEGFGYIPHMHQNTGFVLASATHILKLERYRGD

SEQ ID NO: 833199 - protein, 1369 aa, Homo sapiens
TKLNFSSQPELHTPVFSISDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 833200 - protein, 1109 aa, Homo sapiens
MVTFCLLPGRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 833201 - protein, 302 aa, Homo sapiens
TKLNFSSQPELHTPVFSISDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCSCAGGRWVSHCPQTRGGGFQAGSRSQVSVCCYQ

SEQ ID NO: 833202 - protein, 1199 aa, Homo sapiens
TKLNFSSQPELHTPVFSISDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYRGSW

SEQ ID NO: 833203 - protein, 325 aa, Homo sapiens
TKLNFSSQPELHTPVFSISDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGRGCSESRSHH

SEQ ID NO: 833204 - protein, 37 aa, Homo sapiens
MRTTKVYKLVIHKKGFGGSGQYRLVFRGFVSWLRFWC

SEQ ID NO: 833205 - protein, 107 aa, Homo sapiens
EWEDMIEDAAHETVPIMLVGNKADIRDTAATEGQKCVPGHFGEKLAMTYGALFCETSAKDGSNIVEAVLHLAREVKKRTDKDDSRSITNLTGTNSKKSPQMKNCCNG

SEQ ID NO: 833206 - protein, 107 aa, Homo sapiens; identical to SEQ ID NO: 833205

SEQ ID NO: 833207 - protein, 131 aa, Homo sapiens [sequence omitted]

SEQ ID NO: 833208 - protein, 131 aa, Homo sapiens [sequence omitted]

SEQ ID NO: 833209 - protein, 131 aa, Homo sapiens [sequence omitted]

SEQ ID NO: 833210 - protein, 131 aa, Homo sapiens [sequence omitted]

SEQ ID NO: 833211 - protein, 107 aa, Homo sapiens
AGRRSGSRVRGTSGVKSPQAGNKPRPNSHPPAFLQLDLEAASPVWDAADARLLALAASPRLRSSVAAATVTRSPRPAQFSSTLGERESQMPLLNSLFKTHLLGDWTR

SEQ ID NO: 833212 - protein, 1408 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 833213 - protein, 1408 aa, Homo sapiens; identical to SEQ ID NO: 833212

SEQ ID NO: 833214 - protein, 523 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 833215 - protein, 932 aa, Homo sapiens
MGQFSEVLLTSISTFIKGDLTIANLGTSEGRFMQVVVSRSGPSTPHVNFLLDSHPVSPEVIVEHTLNQNGYTLVITGKKCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 833216 - protein, 490 aa, Homo sapiens
WGDSTAIPIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 833217 - protein, 1408 aa, Homo sapiens; identical to SEQ ID NO: 833212

SEQ ID NO: 833218 - protein, 934 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEVGFLHSSHDVNKEASVIMLFSGLK

SEQ ID NO: 833219 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 833220 - protein, 1312 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPL

SEQ ID NO: 833221 - protein, 569 aa, Homo sapiens [sequence omitted]

SEQ ID NO: 833222 - protein, 1301 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGSK

SEQ ID NO: 833223 - protein, 325 aa, Homo sapiens
MANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 833224 - protein, 325 aa, Homo sapiens; identical to SEQ ID NO: 833223

SEQ ID NO: 833225 - protein, 337 aa, Homo sapiens
MLGVAAGMTHSNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 833226 - protein, 343 aa, Homo sapiens
LGQPADEGHIESRYMTCNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 833227 - protein, 288 aa, Homo sapiens
MANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLK

SEQ ID NO: 833228 - protein, 117 aa, Homo sapiens
MAFSGRARPCIIPENEEIPRAALNTVHEANGTEDERAVSKLQRRHSDVKVYKEFCDFYAKFNMANALASATCERCKGGFAPAEKIVNSNGELYHEQCFVCAQCFQQFPEGLFYEERT

SEQ ID NO: 833229 - protein, 221 aa, Homo sapiens
MFLYEENLILHRCVVGKFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLLVMLSLHRV

SEQ ID NO: 833230 - protein, 387 aa, Homo sapiens
MAFSGRARPCIIPENEEIPRAALNTVHEANGTEDERAVSKLQRRHSDVKVYKEFCDFYAKFNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 833231 - protein, 334 aa, Homo sapiens
MGYQRKSYNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 833232 - protein, 73 aa, Homo sapiens
KAKGKLSSRGVEGSEDNNMANALASATCERCKGGFAPAEKIVNSNGELYHEQCFVCAQCFQQFPEGLFYEERT

SEQ ID NO: 833233 - protein, 290 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEVLELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 833234 - protein, 330 aa, Homo sapiens
MDTNLNGRGLETWSSWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 833235 - protein, 211 aa, Homo sapiens
MSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 833236 - protein, 209 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPKHPWMLL

SEQ ID NO: 833237 - protein, 286 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPKPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 833238 - protein, 281 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHERSLWGSWLPCKSTTALRPPCCEEAQATHV

SEQ ID NO: 833239 - protein, 281 aa, Homo sapiens; identical to SEQ ID NO: 833238

SEQ ID NO: 833240 - protein, 279 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHGCGHFCHGKVEFRLGAVAEACTLSTLGG

SEQ ID NO: 833241 - protein, 335 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 833242 - protein, 310 aa, Homo sapiens [sequence omitted]

SEQ ID NO: 833243 - protein, 211 aa, Homo sapiens; identical to SEQ ID NO: 833235

SEQ ID NO: 833244 - protein, 281 aa, Homo sapiens; identical to SEQ ID NO: 833238

SEQ ID NO: 833245 - protein, 281 aa, Homo sapiens; identical to SEQ ID NO: 833238

SEQ ID NO: 833246 - protein, 105 aa, Homo sapiens
SWRGASGGSLCGPLCGSLCGSSRGTWYGPLRGSSCGSMCQHAHLGDAFSMNHIDVSCCTKSGCNHPDLDVQYRSGAAPQPGPAHLSLTITLLMTARLWGGTLLWT

SEQ ID NO: 833247 - protein, 92 aa, Homo sapiens
MSCERGRHQSLQCRSPEEQCLDVVTHWIQEGEEGRPKDDRHLRGCGYLPGCPGSNGFHNNDTFHFLKCCNTTKCNEGPILELEMVANPGYRA

SEQ ID NO: 833248 - protein, 803 aa, Homo sapiens
MDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 833249 - protein, 739 aa, Homo sapiens
MVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 833250 - protein, 818 aa, Homo sapiens
MPGHPGSWEMGPLTFMDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 833251 - protein, 470 aa, Homo sapiens
MVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKL

SEQ ID NO: 833252 - protein, 809 aa, Homo sapiens
MGPLTFMDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 833253 - protein, 470 aa, Homo sapiens; identical to SEQ ID NO: 833251

SEQ ID NO: 833254 - protein, 2058 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGTEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 833255 - protein, 87 aa, Homo sapiens
SYKQDTTMTRRRKETGEHAYTRESVTFSNSYGSQWSPDYRCSVGTYNSSGAYRFSSEGAQSSVSTCLACPSEMGGRSHPPLLHPQVE

SEQ ID NO: 833256 - protein, 1683 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGTEMEKYALFTYESLKKTKCRE

SEQ ID NO: 833257 - protein, 1415 aa, Homo sapiens
MPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGTEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 833258 - protein, 2058 aa, Homo sapiens; identical to SEQ ID NO: 833254

SEQ ID NO: 833259 - protein, 300 aa, Homo sapiens
EILLQTLLLPGHIHGRSPTSDVAWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 833260 - protein, 1457 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKCQIQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKRE

SEQ ID NO: 833261 - protein, 1269 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRCCLRYPSTTLHRPRPRDMVTDSRAVVLGRRVGIADTML

SEQ ID NO: 833262 - protein, 942 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKLMGSKMLQSSPISCGIMATERLANYTGGIYAEYQDTTYINHVFPWLVGITDDAASVR

SEQ ID NO: 833263 - protein, 547 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVLGDSDILGFFFCFSVFRVKASGGVVLFSVGEMGDVATSRVGVTGSGSITDRVIQILCALGVEQSLVL

SEQ ID NO: 833264 - protein, 2049 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGTEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVEVRTGCHVLGWAGCWHLRTWITAKFMWREDKMEHFALSTSFFRAPKIVPLTPPFSSQFLFSCVVNASVILGMNAKLRCHLFFYPSLGKL

SEQ ID NO: 833265 - protein, 2034 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDSFHNEDLLEKNRVVSEIYEYYLRQNKIYLEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGTEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 833266 - protein, 741 aa, Homo sapiens
EARKKALSLGSHRGDADGRAKGLCFLLILWLRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGTEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 833267 - protein, 1852 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGTEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHGCIPETS

SEQ ID NO: 833268 - protein, 1349 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDR

SEQ ID NO: 833269 - protein, 982 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEIFAPEKGSHSFPEATQRSDCSESLQTIAGREKGARRKEETGRGRKEETG

SEQ ID NO: 833270 - protein, 123 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYPFTGDVSVCWTPLTSRQDRHLSEQPLLLHI

SEQ ID NO: 833271 - protein, 70 aa, Homo sapiens
RVSPRNVLSSSKSETKQLFLEGSLHPCNVLMCPHTCVTNLPKPRQKQPGMCTTWAACEVREFPWGCTALG

SEQ ID NO: 833272 - protein, 1352 aa, Homo sapiens
SAPPDVTTYTSEHSIQVERPQGSTGSRTAPKYGNAELMETGDGVPVSSRVSAKIQQLVNTLKRPKRPPLREFFVDDFEELLEVQQPDPNQPKPEGAQMLAMRGEQLGVVTNWPPSLEAALQRWGTISPKAPCLTTMDTNGKPLYILTYGKLWTRSMKVAYSILHKLGTKQEPMVRPGDRVALVFPNNDPAAFMAAFYGCLLAEVVPVPIEVPLTRKDAGSQQIGFLLGSCGVTVALTSDACHKGLPKSPTGEIPQFKGWPKLLWFVTESKHLSKPPRDWFPHIKDANNDTAYIEYKTCKDGSVLGVTVTRTALLTHCQALTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRGAIANSLTCVQLHKRAEKIAVMLMERGHLQDGDHVALVYPPGIDLIAAFYGCLYAGCVPITVRPPHPQNIATTLPTVKMIVEVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 833273 - protein, 1352 aa, Homo sapiens; identical to SEQ ID NO: 833272

SEQ ID NO: 833274 - protein, 940 aa, Homo sapiens
MADDVIAPKYNLRINIKAIEIFIDVSTMKFDMLLQQENSWLFRENECLADYHPCSFAPDPIPVHWCRSYSRLPCFLYSPHLPPLTLHVLSCLLLAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRGAIANSLTCVQLHKRAEKIAVMLMERGHLQDGDHVALVYPPGIDLIAAFYGCLYAGCVPITVRPPHPQNIATTLPTVKMIVEVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 833275 - protein, 69 aa, Homo sapiens
WLHRSVLVLKTSDVCFAPVSCMTRARSLQAALLKESYVLVPVIGPQGAIANSLTCVQLHKRAEKIAVML

SEQ ID NO: 833276 - protein, 1352 aa, Homo sapiens; identical to SEQ ID NO: 833272

SEQ ID NO: 833277 - protein, 1352 aa, Homo sapiens; identical to SEQ ID NO: 833272

SEQ ID NO: 833278 - protein, 1352 aa, Homo sapiens; identical to SEQ ID NO: 833272

SEQ ID NO: 833279 - protein, 310 aa, Homo sapiens
MKGQQKTAETEEGTVQIQEGAVATGEDPTSVAIASIQSAATFPDPNVKYVFRTENGGQVMYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVLRQQVEDLKNKNLLLRAQLRHHGLEVVIKNDSN

SEQ ID NO: 833280 - protein, 310 aa, Homo sapiens; identical to SEQ ID NO: 833279

SEQ ID NO: 833281 - protein, 166 aa, Homo sapiens
MKGQQKTAETEEGTVQIQEGAVATGEDPTSVAIASIQSAATFPDPNVKYVFRTENGGQVMYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGEILHEDAG

SEQ ID NO: 833282 - protein, 244 aa, Homo sapiens
MKGQQKTAETEEGTVQIQEGAVATGEDPTSVAIASIQSAATFPDPNVKYVFRTENGGQVMYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGQFFVMMSPQEVLQGGSQRSIAPRTHPYSPKSEAPRTTRDEKRRAQHNEVERRRRDKINNWIVQLSKIIPDCSMESTKSGQVMERPW

SEQ ID NO: 833283 - protein, 251 aa, Homo sapiens
MYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVLRQQVEDLKNKNLLLRAQLRHHGLEVVIKNDSN

SEQ ID NO: 833284 - protein, 437 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833285 - protein, 278 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDELRRERPASRFAGRPDVEDQNGGRTGEGPDDREPTERGARERKREETWARTKREHRALTAKIGT

SEQ ID NO: 833286 - protein, 138 aa, Homo sapiens
MPFPTPLPWVQGPSGPSSEHGQHRLLDPCVPASADAAGGREHGFGGGEVTPGPRRGWAVCLVQCDSGIGEGGQVSEASLAFFVNSHEIVQGFPAPRGMRPEVGAVARTTGWRVWATTAETCTWSLRAATATWLRRMGI

SEQ ID NO: 833287 - protein, 428 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833288 - protein, 394 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRPAGVGSGPGGSGSARRSCVAAVATWRSPPRRVTRPLMMGLQGSSGLTALTVQRKRAGIVTGSDGGATGASASGAGTGIVTVTVTASTNGGSGAVSGAGMRPEVGAVARTTGWRVWATTAETCTWSLRAATATWLRRMGI

SEQ ID NO: 833289 - protein, 437 aa, Homo sapiens; identical to SEQ ID NO: 833284

SEQ ID NO: 833290 - protein, 122 aa, Homo sapiens
MAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833291 - protein, 122 aa, Homo sapiens; identical to SEQ ID NO: 833290

SEQ ID NO: 833292 - protein, 341 aa, Homo sapiens
MEQALHRFGRGLVWLSVAWLSVGRVRVRDDGDTGRGFCRAGPVLTRGPSGDSSPLPLPTSVTAAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833293 - protein, 391 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRQDNGLEGLGNDSRDMYMESEGGDGYLAPENGYLMEAAPE

SEQ ID NO: 833294 - protein, 332 aa, Homo sapiens
MEQALHRFGRGLVWLSVAWLSVGRVRVRDDGDTGRGFCRAGPVLTRGPSGDSSPLPLPTSVTAAYKHADGKKIDGRRVLVDVERGRTVKGWRPRRLGGGLGGTRRGGADVNIRHSGRDDTSRYDERDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833295 - protein, 262 aa, Homo sapiens
YSWSVPSPFDGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833296 - protein, 317 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERTQESAALQKRPPSG

SEQ ID NO: 833297 - protein, 341 aa, Homo sapiens; identical to SEQ ID NO: 833292

SEQ ID NO: 833298 - protein, 254 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLGSDGGATGASASGAGTGIVTVTVTASTNGGSGAVSGAGMRPEVGAVARTTGWRVWATTAETCTWSLRAATATWLRRMGI

SEQ ID NO: 833299 - protein, 166 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSTTQLACS

SEQ ID NO: 833300 - protein, 149 aa, Homo sapiens
MTQFLPPNLLALFAPRDPIPYLPPLGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833301 - protein, 102 aa, Homo sapiens
MGLQGSSGLTALTVQRKRAGIVTGSDGGATGASASGAGTGIVTVTVTASTNGGSGAVSGAGMRPEVGAVARTTGWRVWATTAETCTWSLRAATATWLRRMGI

SEQ ID NO: 833302 - protein, 166 aa, Homo sapiens; identical to SEQ ID NO: 833299

SEQ ID NO: 833303 - protein, 166 aa, Homo sapiens; identical to SEQ ID NO: 833299

SEQ ID NO: 833304 - protein, 66 aa, Homo sapiens
QQEINFIFKSKGPEQMRHLPLEDKLKCQDNGLEGLGNDSRDMYMESEGGDGYLAPENGYLMEAAPE

SEQ ID NO: 833305 - protein, 34 aa, Homo sapiens
MERKRREKIERRQQEVETELKMWDPHNDPNSTGG

SEQ ID NO: 833306 - protein, 437 aa, Homo sapiens; identical to SEQ ID NO: 833284

SEQ ID NO: 833307 - protein, 298 aa, Homo sapiens
MGVRGMNCTGGPGPVNTKPGAAFLPFALGVGSFLLLRALSLPRFTLLSVCPAPGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833308 - protein, 437 aa, Homo sapiens; identical to SEQ ID NO: 833284

SEQ ID NO: 833309 - protein, 437 aa, Homo sapiens; identical to SEQ ID NO: 833284

SEQ ID NO: 833310 - protein, 437 aa, Homo sapiens; identical to SEQ ID NO: 833284

SEQ ID NO: 833311 - protein, 437 aa, Homo sapiens; identical to SEQ ID NO: 833284

SEQ ID NO: 833312 - protein, 505 aa, Homo sapiens
VDHMMLTALEARRLEEARWSRRGGADVNIRHSGRDDTSRYDERPGPSPLPHRDRDRDRERERRERSRERYKERERRRSRSRDRRRRYGVATRREKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833313 - protein, 397 aa, Homo sapiens
RYPVRRRLSDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833314 - protein, 122 aa, Homo sapiens; identical to SEQ ID NO: 833290

SEQ ID NO: 833315 - protein, 298 aa, Homo sapiens; identical to SEQ ID NO: 833307

SEQ ID NO: 833316 - protein, 289 aa, Homo sapiens
MGVRGMNCTGGPGPVNTKPGAAFLPFALGVGSFLLLRALSLPRFTLLSVCPAPGGGLGGTRRGGADVNIRHSGRDDTSRYDERDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833317 - protein, 234 aa, Homo sapiens
GRVGRPTRRGRVGSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 833318 - protein, 230 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDESPHIRQPGQ

SEQ ID NO: 833319 - protein, 166 aa, Homo sapiens; identical to SEQ ID NO: 833299

SEQ ID NO: 833320 - protein, 166 aa, Homo sapiens; identical to SEQ ID NO: 833299

SEQ ID NO: 833321 - protein, 113 aa, Homo sapiens
MEQALHRFGRGLVWLSVAWLSVGRVRVRDDGDTGRGFCRAGPVLTRGPSGDSSPLPLPTSVTAAYKHADGKKIDGRRVLVDVERGRTVKGWRPRRLGGASVYQKRWEEGRYRA

SEQ ID NO: 833322 - protein, 1433 aa, Homo sapiens
AGCGRGGGGRRRLDAAAAADPGEPRSERSSESATRRGRNISVMAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASQNKPLWQCYLGRFNDIHVPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQRAESPESSAIESTQSTPQKGRGRPSKTPSPSQPKKNV

SEQ ID NO: 833323 - protein, 164 aa, Homo sapiens
AGCGRGGGGRRRLDAAAAADPGEPRSERSSESATRRGRNISVMAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKASTDLNNSKIDRYFDLSF

SEQ ID NO: 833324 - protein, 1489 aa, Homo sapiens
AGCGRGGGGRRRLDAAAAADPGEPRSERSSESATRRGRNISVMAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASQNKPLWQCYLGRFNDIHVPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQRAESPESSAIESTQSTPQKGRGRPSKTPSPSQPKKNVRVGRSKQAATKENDSSEEVDVFQGSSPVDDIPQEETEEEEVSTVNVRRRSAKRERR

SEQ ID NO: 833325 - protein, 1471 aa, Homo sapiens
AGCGRGGGGRRRLDAAAAADPGEPRSERSSESATRRGRNISVMAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQRAESPESSAIESTQSTPQKGRGRPSKTPSPSQPKKNVRVGRSKQAATKENDSSEEVDVFQGSSPVDDIPQEETEEEEVSTVNVRRRSAKRERR

SEQ ID NO: 833326 - protein, 1433 aa, Homo sapiens; identical to SEQ ID NO: 833322

SEQ ID NO: 833327 - protein, 1489 aa, Homo sapiens; identical to SEQ ID NO: 833324

SEQ ID NO: 833328 - protein, 125 aa, Homo sapiens
MDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQR

SEQ ID NO: 833329 - protein, 73 aa, Homo sapiens
LAAEGEGGGEGDWMRRRRRIPESPGVSGVASRQPGGVEIFLSWLIQRLGPMMEKLHIRLGSRKYQIKYLKRRW

SEQ ID NO: 833330 - protein, 848 aa, Homo sapiens
MIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQRAESPESSAIESTQSTPQKGRGRPSKTPSPSQPKKNVRVGRSKQAATKENDSSEEVDVFQGSSPVDDIPQEETEEEEVSTVNVRRRSAKRERR

SEQ ID NO: 833331 - protein, 1389 aa, Homo sapiens
AGCGRGGGGRRRLDAAAAADPGEPRSERSSESATRRGRNISVMAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASQNKPLWQCYLGRFNDIHVPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQTC

SEQ ID NO: 833332 - protein, 737 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 833333 - protein, 125 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIFKSVLLLD

SEQ ID NO: 833334 - protein, 346 aa, Homo sapiens
MRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKGTGFSIQGCACEGMREL

SEQ ID NO: 833335 - protein, 587 aa, Homo sapiens
MRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 833336 - protein, 553 aa, Homo sapiens
HCRDFIWGVIGKQRYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 833337 - protein, 125 aa, Homo sapiens; identical to SEQ ID NO: 833333

SEQ ID NO: 833338 - protein, 587 aa, Homo sapiens; identical to SEQ ID NO: 833335

SEQ ID NO: 833339 - protein, 125 aa, Homo sapiens; identical to SEQ ID NO: 833333

SEQ ID NO: 833340 - protein, 587 aa, Homo sapiens; identical to SEQ ID NO: 833335

SEQ ID NO: 833341 - protein, 83 aa, Homo sapiens
RAVTRRPCRRLLSGLQRAGPLAEQSGGAAGRRAHEGSAFPVSGGDGIPECQRTVAFPSCSSSRLRWWSAWPVEINENLPARKT

SEQ ID NO: 833342 - protein, 83 aa, Homo sapiens; identical to SEQ ID NO: 833341

SEQ ID NO: 833343 - protein, 83 aa, Homo sapiens; identical to SEQ ID NO: 833341

SEQ ID NO: 833344 - protein, 306 aa, Homo sapiens
GRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMGFRQNQKEGRCSHSLN

SEQ ID NO: 833345 - protein, 292 aa, Homo sapiens
GRGPTLRTRGFAMAMSSGGSGGGVPEQEDSVLFRRGTGQSDDSDIWDDTALIKAYDKAVASFKHALKNGDICETSGKPKTTPKRKPAKKWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMGFRQNQKEGRCSHSLN

SEQ ID NO: 833346 - protein, 96 aa, Homo sapiens
LVRTAAVWRFGVCSLDFRRVHAHAEYPAHLLSCWLPPFPSGPPIIPPPPPICPDSLDDADALGSMLISWYMSGYHTGYYMGFRQNQKEGRCSHSLN

SEQ ID NO: 833347 - protein, 306 aa, Homo sapiens; identical to SEQ ID NO: 833344

SEQ ID NO: 833348 - protein, 306 aa, Homo sapiens; identical to SEQ ID NO: 833344

SEQ ID NO: 833349 - protein, 306 aa, Homo sapiens
GRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMVSNHSASFPDNFFVVM

SEQ ID NO: 833350 - protein, 83 aa, Homo sapiens; identical to SEQ ID NO: 833341

SEQ ID NO: 833351 - protein, 306 aa, Homo sapiens; identical to SEQ ID NO: 833344

SEQ ID NO: 833352 - protein, 294 aa, Homo sapiens
GRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMEMLA

SEQ ID NO: 833353 - protein, 105 aa, Homo sapiens
MVTFVKLRVNQKPHLKENLLRRIKAKRRILQLPYNSGKLGTNVLPPFPSGPPIIPPPPPICPDSLDDADALGSMLISWYMSGYHTGYYMGFRQNQKEGRCSHSLN

SEQ ID NO: 833354 - protein, 83 aa, Homo sapiens; identical to SEQ ID NO: 833341

SEQ ID NO: 833355 - protein, 306 aa, Homo sapiens; identical to SEQ ID NO: 833344

SEQ ID NO: 833356 - protein, 83 aa, Homo sapiens; identical to SEQ ID NO: 833341

SEQ ID NO: 833357 - protein, 567 aa, Homo sapiens
MASHVDLLTELQLLEKVPTLERLRAAQKRRAQQLKKWAQYEQDLQHRKRKHERKRSTGGRRKKVSFEASVALLEASLRNDAEEVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLLHIAGANGYLRAAELLLDHGVRVDVKDWDGWEPLHAAAFWGQMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 833358 - protein, 596 aa, Homo sapiens
MASHVDLLTELQLLEKVPTLERLRAAQKRRAQQLKKWAQYEQDLQHRKRKHERKRSTGGRRKKVSFEASVALLEASLRNDAEEENEWRIHDVTTAPFPGLVQRRSRLLIVSQVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLLHIAGANGYLRAAELLLDHGVRVDVKDWDGWEPLHAAAFWGQMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 833359 - protein, 527 aa, Homo sapiens
MRNRSYENRCPLLARDPLCSERGNEPRGIPGTTLLGAAPLKAWVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLLHIAGANGYLRAAELLLDHGVRVDVKDWDGWEPLHAAAFWGQMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 833360 - protein, 567 aa, Homo sapiens; identical to SEQ ID NO: 833357

SEQ ID NO: 833361 - protein, 567 aa, Homo sapiens; identical to SEQ ID NO: 833357

SEQ ID NO: 833362 - protein, 181 aa, Homo sapiens
MASHVDLLTELQLLEKVPTLERLRAAQKRRAQQLKKWAQYEQDLQHRKRKHERKRSTGGRRKKVSFEASVALLEASLRNDAEEEEEQEPRLWSHVANHLEVRKMLCETEWVRCQRKHKLVSGDVSLQRQPPPASCRDGPAQPHLLQLEMERTRWPCLAQIPARLPGRCRRSSGVGARSRDT

SEQ ID NO: 833363 - protein, 33 aa, Homo sapiens
MASHVDLLTELQLLEKVPTLERLRAAQKRRAQQ

SEQ ID NO: 833364 - protein, 174 aa, Homo sapiens [sequence omitted]

SEQ ID NO: 833365 - protein, 699 aa, Homo sapiens
MASHVDLLTELQLLEKVPTLERLRAAQKRRAQQLKKWAQYEQDLQHRKRKHERKRSTGGRRKKVSFEASVALLEASLRNDAEEGMNGESMINHSPLPWACSEAVSPAHCEPRSVHLPVPLGAHGPSLYNKPSWLSLERPSHASWVPAHTFQSMKEQRGVAFWPKRVLGFSHLALQVLEPSEKCNSTSTLLHRALGNEPRGIPGTTLLGAAPLKAWVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLLHIAGANGYLRAAELLLDHGVRVDVKDWDGWEPLHAAAFWGQMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 833366 - protein, 567 aa, Homo sapiens; identical to SEQ ID NO: 833357

SEQ ID NO: 833367 - protein, 567 aa, Homo sapiens; identical to SEQ ID NO: 833357

SEQ ID NO: 833368 - protein, 169 aa, Homo sapiens
MASHVDLLTELQLLEKVPTLERLRAAQKRRAQQLKKWAQYEQDLQHRKRKHERKRSTGGRRKKVSFEASVALLEASLRNDAEEGMNGESMINHSPLPWACSEAVSPAHCEPRSVHLPVPLGAHGPSLYNKPSWLSLERPSHASWVPAHTFQSMKEQRGVALLAQEGAGF

SEQ ID NO: 833369 - protein, 109 aa, Homo sapiens
EVKWLAQGQGQCLQCEHHGAGFKQAFHSLPHGLLRGTWCVLTRARGPVPCLELTLPVCLSQCCIDNFEEIVKLLLSHGANVNAKDNELWTPLHAAATCGHINLVKILVQ

SEQ ID NO: 833370 - protein, 130 aa, Homo sapiens
MFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATDSGYPETLVNLIVLVPAPGQAP

SEQ ID NO: 833371 - protein, 70 aa, Homo sapiens
SGDEGSELRGPLTSSMLLLPGGEKLQDAYYIFQEMADKCSPTLLLLNGQAACHNGPGPLGRPLRACCRRR

SEQ ID NO: 833372 - protein, 158 aa, Homo sapiens
MFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHNGPGPLGRPLRACCRRR

SEQ ID NO: 833373 - protein, 158 aa, Homo sapiens; identical to SEQ ID NO: 833372

SEQ ID NO: 833374 - protein, 158 aa, Homo sapiens; identical to SEQ ID NO: 833372

SEQ ID NO: 833375 - protein, 158 aa, Homo sapiens; identical to SEQ ID NO: 833372

SEQ ID NO: 833376 - protein, 158 aa, Homo sapiens; identical to SEQ ID NO: 833372

SEQ ID NO: 833377 - protein, 249 aa, Homo sapiens
MSASQGAPRVASSHQSWERGLGRPCPPASSWSQPCRHLDFRLTASRAVRNESLLSLTARAVVLCHSSSRTLRQVTSQGHCFSHPALTSPAGVKAGNPGSPRSSSCCEHHRKAAPESRRSRQGLVVRSSGCTAATSLAGRPGDKEHPLVIGFGFDFVFLRYGLALSFSLACSGTILAYCSLDLPGSGDHPTSASRIAGTAGTHHHAWLVCIFFRDGVLPGRAQWLTPVIPKRWGYRCEPQYPAPLVIVTP

SEQ ID NO: 833378 - protein, 249 aa, Homo sapiens; identical to SEQ ID NO: 833377

SEQ ID NO: 833379 - protein, 185 aa, Homo sapiens
MPYLGRKFGVVLDEIKPSSAPELQAVRMFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHNGPGPLGRPLRACCRRR

SEQ ID NO: 833380 - protein, 158 aa, Homo sapiens; identical to SEQ ID NO: 833372

SEQ ID NO: 833381 - protein, 111 aa, Homo sapiens
MCLWRPADRPLALSCSTAMTVQILLKLDRLDLARKELKRMQDLDEDATLTQLATAWVSLATGGEKLQDAYYIFQEMADKCSPTLLLLNGQAACHNGPGPLGRPLRACCRRR

SEQ ID NO: 833382 - protein, 123 aa, Homo sapiens
MFADYLAHESRRDSIVAELDREMSRSVDVTNTTFLLMAASIYLHDQNPDAALRALHQGDSLECTAMTVQILLKLDRLDLARVVRSCRMPTTSSRRWLTSARPPCCCSMGRRPATMAQGRWGGR

SEQ ID NO: 833383 - protein, 144 aa, Homo sapiens
MFADYLAHESRRDSIVAELDREMSRSVDVTNTTFLLMAASIYLHDQNPDAALRALHQGDSLECTAMTVQILLKLDRLDLARKELKRMQDLDEDATLTQLATAYYIFQEMADKCSPTLLLLNGQAACHNGPGPLGRPLRACCRRR

SEQ ID NO: 833384 - protein, 112 aa, Homo sapiens
MFADYLAHESRRDSIVAELDREMSRSVDVTNTTFLLMAASIYLHDQNPDAALRALHQGDSLEWKELKRMQDLDEDATLTQLATAWVSLATDSGYPETLVNLIVLVPAPGQAP

SEQ ID NO: 833385 - protein, 158 aa, Homo sapiens; identical to SEQ ID NO: 833372

SEQ ID NO: 833386 - protein, 158 aa, Homo sapiens; identical to SEQ ID NO: 833372

SEQ ID NO: 833387 - protein, 158 aa, Homo sapiens; identical to SEQ ID NO: 833372

SEQ ID NO: 833388 - protein, 158 aa, Homo sapiens; identical to SEQ ID NO: 833372

SEQ ID NO: 833389 - protein, 249 aa, Homo sapiens; identical to SEQ ID NO: 833377

SEQ ID NO: 833390 - protein, 182 aa, Homo sapiens
MFADYLAHESRRDSIVAELDREMSRSVDVTNTTFLLMAASIYLHDQNPDAALRALHQGDSLECRVSSPGRALHLEAQPMEAASPDGRTAMTVQILLKLDRLDLARKELKRMQDLDEDATLTQLATAWVSLATGGEKLQDAYYIFQEMADKCSPTLLLLNGQAACHNGPGPLGRPLRACCRRR

SEQ ID NO: 833391 - protein, 249 aa, Homo sapiens; identical to SEQ ID NO: 833377

SEQ ID NO: 833392 - protein, 152 aa, Homo sapiens
MVSPKRDSIVAELDREMSRSVDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHNGPGPLGRPLRACCRRR

SEQ ID NO: 833393 - protein, 107 aa, Homo sapiens
MFADYLAHESRSTAMTVQILLKLDRLDLARKELKRMQDLDEDATLTQLATAWVSLATGGEKLQDAYYIFQEMADKCSPTLLLLNGQAACHNGPGPLGRPLRACCRRR

SEQ ID NO: 833394 - protein, 130 aa, Homo sapiens; identical to SEQ ID NO: 833370

SEQ ID NO: 833395 - protein, 249 aa, Homo sapiens; identical to SEQ ID NO: 833377

SEQ ID NO: 833396 - protein, 1108 aa, Homo sapiens
LDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKVFLEFFS

SEQ ID NO: 833397 - protein, 1252 aa, Homo sapiens [sequence omitted]

SEQ ID NO: 833398 - protein, 1252 aa, Homo sapiens [sequence omitted]

SEQ ID NO: 833399 - protein, 2217 aa, Homo sapiens
VNEEKTESGNWMIGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833400 - protein, 2848 aa, Homo sapiens
LDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833401 - protein, 2879 aa, Homo sapiens
LDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKETGSCSVTQAGLELLASRDPPTLASQNAGITDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833402 - protein, 2857 aa, Homo sapiens
LDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHFPFGFLFEQSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833403 - protein, 2287 aa, Homo sapiens
GALCRGALCRGEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833404 - protein, 2822 aa, Homo sapiens
LDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHIHQEPSLLHRLVHLLLLKERKEKRKRQNGWIHSLEMFRTHFLMRKKQNVAPIKERNLGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833405 - protein, 1291 aa, Homo sapiens
FTSHHWASLSVCFPNLHPKFQLYIYNQLVRFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833406 - protein, 874 aa, Homo sapiens [sequence omitted]

SEQ ID NO: 833407 - protein, 219 aa, Homo sapiens [sequence omitted]

SEQ ID NO: 833408 - protein, 1203 aa, Homo sapiens
VNEEKTESGNWMIGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLEVRHRKKGV

SEQ ID NO: 833409 - protein, 416 aa, Homo sapiens
LDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEETEEKTVEEEHPEGEEVYGEEADTKEVVEQVQRLELLVVTGLESSVIFRCGVAHGLYFCTQLLSPLYFCLWCEKPDSQCD

SEQ ID NO: 833410 - protein, 72 aa, Homo sapiens
LDILKRRQHDVKLEKLKERIRKQWEHSEETNGRGQKLGHIDHPVMVVNVDNSVTAKVRKVATAPPAPAYKGL

SEQ ID NO: 833411 - protein, 1252 aa, Homo sapiens [sequence omitted]

SEQ ID NO: 833412 - protein, 2217 aa, Homo sapiens; identical to SEQ ID NO: 833399

SEQ ID NO: 833413 - protein, 2802 aa, Homo sapiens
LDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEEKSICFTLSDKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833414 - protein, 2479 aa, Homo sapiens
LGDLEDPVRRKQLCFQASIRSSYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833415 - protein, 2217 aa, Homo sapiens; identical to SEQ ID NO: 833399

SEQ ID NO: 833416 - protein, 1449 aa, Homo sapiens
YGLSSTRRSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833417 - protein, 1247 aa, Homo sapiens
MTLLFVGDKNAVSNNMLKTMFISVIFPLTKIVSFFSCFHLLCLEIASEEESPVPLYSHLNSESSIPEELGSPAVEYVPSESIGQEQPGSPDHSILTEEMICSQELESSTSPSKHFPFGFLFEQSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 833418 - protein, 106 aa, Homo sapiens [sequence omitted]

SEQ ID NO: 833419 - protein, 444 aa, Homo sapiens
LDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQVIVVTYTKESHSWLGNAYLLYYLKITHHS

SEQ ID NO: 833420 - protein, 625 aa, Homo sapiens
EGSEARHCWGEEGSEERGAGRGSSGGREEGARRREEGLAPRRNVNQSPEPRESPPICSDLTWLLAAALAAAEQINRRTRSTAQRGRQRGPKPGPAPDARRSPRAALSWAARGSGPLSVRAPRATMSFPQLGYQYIRPLYPSERPGAAGGSGGSAGARGGLGAGASELNASGSLSNVLSSVYGAPYAAAAAAAAAQGYGAFLPYAAELPIFPQLGAQYELKDSPGVQHPAAAAAFPHPHPAFYPYGQYQFGDPSRPKNATRESTSTLKAWLNEHRKNPYPTKGEKIMLAIITKMTLTQVSTWFANARRRLKKENKMTWAPRSRTDEEGNAYGSEREEEDEEEDEEDGKRELELEEEELGGEEEDTGGEGLADDDEDEEIDLENLDGAATEPELSLAGAARRDGDLGLGPISDSKNSDSEDSSEGLEDRPLPVLSLAPAPPPVAVASPSLPSPPVSLDPCAPAPAPASALQKPKIWSLAETATSPDNPRRSPPGAGGSPPGAAVAPSALQLSPAAAAAAAHRLVSAPLGKFPAWTNRPFPGPPPGPRPHPLSLLGSAPPHLLGLPGAAGHPAAAAAFARPAEPEGGTDRCSALEVEKKLLKTAFQPVPRRPQNHLDAALVLSALSSS

SEQ ID NO: 833421 - protein, 273 aa, Homo sapiens
EGSEARHCWGEEGSEERGAGRGSSGGREEGARRREEGLAPRRNVNQSPEPRESPPICSDLTWLLAAALAAAEQINRRTRSTAQRGRQRGPKPGPAPDARRSPRAALSWAARGSGPLSVRAPRATMSFPQLGYQYIRPLYPSERPGAAGGSGGSAGARGGLGAGASELNASGSLSNVLSSVYGAPYAAAAAAAAAQGYGAFLPYAAELPIFPQLIAVVPWKWRKSYSRQLSSPCPGGPRTIWTPPWSYRLSPHPSSLKKTKKQKKLFLIVVIIV

SEQ ID NO: 833422 - protein, 349 aa, Homo sapiens
EGSEARHCWGEEGSEERGAGRGSSGGREEGARRREEGLAPRRNVNQSPEPRESPPICSDLTWLLAAALAAAEQINRRTRSTAQRGRQRGPKPGPAPDARRSPRAALSWAARGSGPLSVRAPRATMSFPQLGYQYIRPLYPSERPGAAGGSGGSAGARGGLGAGASELNASGSLSNVLSSVYGAPYAAAAAAAAAQGYGAFLPYAAELPIFPQLGAQYELKDSPGVQHPAAAAAFPHPHPAFYPYGQYQFGDPSRPKNATRESTSTLKAWLNEHRKNPYPTKGEKIMLAIITKSLLWHPAFAVRFVCPVDFGGWSFSENKRVCLCVCVYIQRNVHMCEPNCTRKYLFLAK

SEQ ID NO: 833423 - protein, 159 aa, Homo sapiens
PWASYDTTRMGANVGTILTRRPWDRTLTGPIVKNETYIKKSGTLKAWLNEHRKNPYPTKGEKIMLAIITKMTLTQVSTWFANARRRLKKENKMTWAPRSRSEDEEEEENIDLEKNDEDEPQKPEDKGDPEGPEAGGAEQKAASGCERLQGPPTPAGKET

SEQ ID NO: 833424 - protein, 625 aa, Homo sapiens; identical to SEQ ID NO: 833420

SEQ ID NO: 833425 - protein, 220 aa, Homo sapiens
EGSEARHCWGEEGSEERGAGRGSSGGREEGARRREEGLAPRRNVNQSPEPRESPPICSDLTWLLAAALAAAEQINRRTRSTAQRGRQRGPKPGPAPDARRSPRAALSWAARGSGPLSVRAPRATMSFPQLGYQYIRPLYPSERPGAAPPSLGQRSPKAEQIAVVPWKWRKSYSRQLSSPCPGGPRTIWTPPWSYRLSPHPSSLKKTKKQKKLFLIVVIIV

SEQ ID NO: 833426 - protein, 113 aa, Homo sapiens
MIKGVTLGFRYKMRSVYAHFPINVVIQENGSLVEIRNFLGEKYIRRVRMRPGVACSVSQAQKDELILEGNDIELVSNSAALIQQATTVKNKDIRKFLDGIYVSEKGTVQQADE

SEQ ID NO: 833427 - protein, 136 aa, Homo sapiens
MKTILSNQTVDIPENVDITLKGRTVIVKGPRGTLRRDFNHINVELSLLGKKKKRLRVDKWWGNRKELATVRMRPGVACSVSQAQKDELILEGNDIELVSNSAALIQQATTVKNKDIRKFLDGIYVSEKGTVQQADE

SEQ ID NO: 833428 - protein, 91 aa, Homo sapiens
FFAASTARMKTILSNQTVDIPENVDITLKGRTVIVKGPRGTLRRDFNHINVELSLLGKKKKRLRVDKWWGNRKELATVRTICSHVQNMIKG

SEQ ID NO: 833429 - protein, 114 aa, Homo sapiens
FFAASTARMKTILSNQTVDIPENVDITLKGRTVIVKGPRGTLRRDFNHINVELSLLGKKKKRLRVDKWWGNRKELATVRGLCMLTSPSTLLSRRMGLLLKSEISWVKNTSAGFG

SEQ ID NO: 833430 - protein, 192 aa, Homo sapiens [sequence omitted]

SEQ ID NO: 833431 - protein, 194 aa, Homo sapiens
MKTILSNQTVDIPENVDITLKGRTVIVKGPRGTLRRDFNHINVELSLLGKKKKRLRVDKWWGNRKELATVRTICSHVQNMIKGVTLGFRYKMRSVYAHFPINVVIQENGSLVEIRNFLGEKYIRRVRMRPGVACSVSQAQKDELILEGNDIELVSNSAALIQQATTVVNPKATVNPQATVNPQATVNPQATVNP

SEQ ID NO: 833432 - protein, 192 aa, Homo sapiens [sequence omitted]

SEQ ID NO: 833433 - protein, 113 aa, Homo sapiens; identical to SEQ ID NO: 833426

SEQ ID NO: 833434 - protein, 221 aa, Homo sapiens
FFAASTARMKTILSNQTVDIPENVDITLKGRTVIVKGPRGTLRRDFNHINVELSLLGKKKKRLRVDKWWGNRKELATVLPIGRCMVRRDHASTGVYTAARRYAVTKAMMSLVVNGVLSPSDNAVGIVAGRRHVVLLAMITPEEFRGREESSTYRQGMRPGVACSVSQAQKDELILEGNDIELVSNSAALIQQATTVKNKDIRKFLDGIYVSEKGTVQQADE

SEQ ID NO: 833435 - protein, 184 aa, Homo sapiens
DTTGKEMLGDPVRLVLMIEPIRTVLVAENVNEKPPRLGRKPRLDTFEQNPPVRHVLEHFDGKWYEGGIASYTTKGVTLGFRYKMRSVYAHFPINVVIQENGSLVEIRNFLGEKYIRRVRMRPGVACSVSQAQKDELILEGNDIELVSNSAALIQQATTVKNKDIRKFLDGIYVSEKGTVQQADE

SEQ ID NO: 833436 - protein, 172 aa, Homo sapiens
MKTILSNQTVDIPENVDITLKGRTVIVKGPRGTLRRDFNHINVELSLLGKKKKRLRVDKWWGNRKELATVRTICSHVQNMIKGVTLGFRYKMRSVYAHFPINVVIQENGSLVEIRNFLGEKYIRRVRMRPGVACSVSQAQKDESKPLNLKQAICHFLQGLIRRPAANLVVVV

SEQ ID NO: 833437 - protein, 69 aa, Homo sapiens
QTPFWTLEMEGTLQVHASQSWSLRSPEPAPASGKMTPKWQPQSGGRVLENNRNRSICLPGVDKTVYVKP

SEQ ID NO: 833438 - protein, 340 aa, Homo sapiens
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833439 - protein, 340 aa, Homo sapiens; identical to SEQ ID NO: 833438

SEQ ID NO: 833440 - protein, 340 aa, Homo sapiens; identical to SEQ ID NO: 833438

SEQ ID NO: 833441 - protein, 340 aa, Homo sapiens; identical to SEQ ID NO: 833438

SEQ ID NO: 833442 - protein, 340 aa, Homo sapiens; identical to SEQ ID NO: 833438

SEQ ID NO: 833443 - protein, 341 aa, Homo sapiens
EDGVMSDGEDDLRVARKGLSERGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833444 - protein, 340 aa, Homo sapiens; identical to SEQ ID NO: 833438

SEQ ID NO: 833445 - protein, 251 aa, Homo sapiens
SEREGRCERPVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833446 - protein, 211 aa, Homo sapiens
MVRGWVSAYKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833447 - protein, 197 aa, Homo sapiens
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQELKCTSGCLT

SEQ ID NO: 833448 - protein, 263 aa, Homo sapiens
AGLSSKPIDSVGQCYSHLSVEYLLSLESGVALLCWRPLVSASHTMAADAHPSVYSEFCCNVRHQEGMLRRSEVHTAPIGRSSLEGTHIKFAIAPVSLITACPLEALFLMQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833449 - protein, 189 aa, Homo sapiens
RHEGLVSSFIPFPRVRRWSVDIFYTLWSDRVCDLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833450 - protein, 163 aa, Homo sapiens [sequence omitted]

SEQ ID NO: 833451 - protein, 340 aa, Homo sapiens; identical to SEQ ID NO: 833438

SEQ ID NO: 833452 - protein, 340 aa, Homo sapiens; identical to SEQ ID NO: 833438

SEQ ID NO: 833453 - protein, 340 aa, Homo sapiens; identical to SEQ ID NO: 833438

SEQ ID NO: 833454 - protein, 340 aa, Homo sapiens; identical to SEQ ID NO: 833438

SEQ ID NO: 833455 - protein, 326 aa, Homo sapiens
MADSVKTFLQDLARLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833456 - protein, 383 aa, Homo sapiens
MADSVKTFLQDLARGIKDSIWGICTISKLDARIQQKREEQRRRRASSVLAQRRAQSIERKQERRILALSPSCHLRLPWCNLSLLQPLPPRSKQFFCLSEPAGWKYSEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833457 - protein, 321 aa, Homo sapiens
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833458 - protein, 340 aa, Homo sapiens; identical to SEQ ID NO: 833438

SEQ ID NO: 833459 - protein, 171 aa, Homo sapiens
MVLGFRGFGIKIFHICSSGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 833460 - protein, 148 aa, Homo sapiens
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLCPSSVLAMTAQGPLPPSTCPPYRLYI

SEQ ID NO: 833461 - protein, 129 aa, Homo sapiens
IAASCLFPSRHLLTQCTQPWRTARSTSSPGHPTVPLHSSPSHPKNGFSSRAALASHSVPFTQFTGEDQGPRRSRHSARNARNANSTQPEVGLTQALATPRRPGGRQPLSRASATGDHLGAAAEWQLNRF

SEQ ID NO: 833462 - protein, 180 aa, Homo sapiens
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 833463 - protein, 196 aa, Homo sapiens
GRLLLLNSRPRRREIWMASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 833464 - protein, 238 aa, Homo sapiens
SRPDSFQLKGRSRNGIYFVWLVDSHVPHEQTGAVEVGCRAIVLGIGIAGAPESVCDLRGRVRLLCHLYSQYNGPKRGEDLAGSGACGDTFDREGVRTRLDYSLESAHIADEPRADGQQGVYCKLNDGSAPKVSARARCKSRRALMEWTLIVRSRGMHEERARDGTIDRRVERSLGGEITTLNHKLQDASAEVERLRRENQVLSVRIADKKYYPSSQDSSSAAAPQLLIVLLGLSALLQ

SEQ ID NO: 833465 - protein, 119 aa, Homo sapiens
PVWFWGGSSDVGDLGVVPESLSVALTLPMCSDGAVVLSDEQGVGGLGGPERPVRSDREITTLNHKLQDASAEVERLRRENQVLSVRIADKKYYPSSQDSSSAAAPQLLIVLLGLSALLQ

SEQ ID NO: 833466 - protein, 180 aa, Homo sapiens; identical to SEQ ID NO: 833462

SEQ ID NO: 833467 - protein, 180 aa, Homo sapiens; identical to SEQ ID NO: 833462

SEQ ID NO: 833468 - protein, 180 aa, Homo sapiens; identical to SEQ ID NO: 833462

SEQ ID NO: 833469 - protein, 180 aa, Homo sapiens; identical to SEQ ID NO: 833462

SEQ ID NO: 833470 - protein, 119 aa, Homo sapiens [sequence omitted]

SEQ ID NO: 833471 - protein, 198 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLEHFHCYATQKPTGSYLLTSRLEPICLSPI

SEQ ID NO: 833472 - protein, 198 aa, Homo sapiens; identical to SEQ ID NO: 833471

SEQ ID NO: 833473 - protein, 198 aa, Homo sapiens; identical to SEQ ID NO: 833471

SEQ ID NO: 833474 - protein, 198 aa, Homo sapiens; identical to SEQ ID NO: 833471

SEQ ID NO: 833475 - protein, 142 aa, Homo sapiens
MCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLEHFHCYATQKPTGSYLLTSRLEPICLSPI

SEQ ID NO: 833476 - protein, 142 aa, Homo sapiens; identical to SEQ ID NO: 833475

SEQ ID NO: 833477 - protein, 198 aa, Homo sapiens; identical to SEQ ID NO: 833471

SEQ ID NO: 833478 - protein, 134 aa, Homo sapiens
RSPVFIKEGITCQIFALQPDDVYYCGIKYIKDDVILNEPSADAPAALYQTIEENIKIFEEEEVEFISVPVPEFADSDPANIVHDFNKKLTAYLDLNLDKCYVIPLEHFHCYATQKPTGSYLLTSRLEPICLSPI

SEQ ID NO: 833479 - protein, 196 aa, Homo sapiens
QRWCSQDYRLIHHKYVSTDGGLLCFISSHMKDLLKEEEDKPLPPIKPRKQENSSQENENKTKVSGTKRIKHEIPKYFALQPDDVYYCGIKYIKDDVILNEPSADAPAALYQTIEENIKIFEEEEVEFISVPVPEFADSDPANIVHDFNKKLTAYLDLNLDKCYVIPLEHFHCYATQKPTGSYLLTSRLEPICLSPI

SEQ ID NO: 833480 - protein, 136 aa, Homo sapiens
VCCVVGQFVTAPPPREILAGPDDVYYCGIKYIKDDVILNEPSADAPAALYQTIEENIKIFEEEEVEFISVPVPEFADSDPANIVHDFNKKLTAYLDLNLDKCYVIPLEHFHCYATQKPTGSYLLTSRLEPICLSPI

SEQ ID NO: 833481 - protein, 198 aa, Homo sapiens; identical to SEQ ID NO: 833471

SEQ ID NO: 833482 - protein, 198 aa, Homo sapiens; identical to SEQ ID NO: 833471

SEQ ID NO: 833483 - protein, 198 aa, Homo sapiens; identical to SEQ ID NO: 833471

SEQ ID NO: 833484 - protein, 180 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIADSDPANIVHDFNKKLTAYLDLNLDKCYVIPLEHFHCYATQKPTGSYLLTSRLEPICLSPI

SEQ ID NO: 833485 - protein, 158 aa, Homo sapiens
LSHEAFLETRSVSVCRSSPSYVLKSSLGAYARVAYGDTCVMDDSQLCDIAPILARMPRAWISKPMTRTNPEWSILEVDRTESLIKWSVDRGTLEFASYVRTAADIVHDFNKKLTAYLDLNLDKCYVIPLEHFHCYATQKPTGSYLLTSRLEPICLSPI

SEQ ID NO: 833486 - protein, 186 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLEHFHCYATQNTVEGVPS

SEQ ID NO: 833487 - protein, 183 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLPGFDSHDDYYELDSGSIEVQLQCNVSELTR

SEQ ID NO: 833488 - protein, 194 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEKEDRRWKKKEKKEEKKEEERRAEGKKKKRRKEEEERTRGRREKKKKEGKKKEKEEEERIRKNKKDEEE

SEQ ID NO: 833489 - protein, 198 aa, Homo sapiens; identical to SEQ ID NO: 833471

SEQ ID NO: 833490 - protein, 198 aa, Homo sapiens; identical to SEQ ID NO: 833471

SEQ ID NO: 833491 - protein, 198 aa, Homo sapiens; identical to SEQ ID NO: 833471

SEQ ID NO: 833492 - protein, 198 aa, Homo sapiens; identical to SEQ ID NO: 833471

SEQ ID NO: 833493 - protein, 142 aa, Homo sapiens; identical to SEQ ID NO: 833475

SEQ ID NO: 833494 - protein, 198 aa, Homo sapiens; identical to SEQ ID NO: 833471

SEQ ID NO: 833495 - protein, 170 aa, Homo sapiens
MRWAAAISARKDEHMVEACPVGHWTQGHRPPMCAGHVKGQWLDSCIHIVQRLDVPDDVYYCGIKYIKDDVILNEPSADAPAALYQTIEENIKIFEEEEVEFISVPVPEFADSDPANIVHDFNKKLTAYLDLNLDKCYVIPLEHFHCYATQKPTGSYLLTSRLEPICLSPI

SEQ ID NO: 833496 - protein, 135 aa, Homo sapiens
TERDECTNTTLYGQLSSYAPDDVYYCGIKYIKDDVILNEPSADAPAALYQTIEENIKIFEEEEVEFISVPVPEFADSDPANIVHDFNKKLTAYLDLNLDKCYVIPLEHFHCYATQKPTGSYLLTSRLEPICLSPI

SEQ ID NO: 833497 - protein, 198 aa, Homo sapiens; identical to SEQ ID NO: 833471

SEQ ID NO: 833498 - protein, 198 aa, Homo sapiens; identical to SEQ ID NO: 833471

SEQ ID NO: 833499 - protein, 103 aa, Homo sapiens
AGPSFIVEASDAPAALYQTIEENIKIFEEEEVEFISVPVPEFADSDPANIVHDFNKKLTAYLDLNLDKCYVIPLEHFHCYATQKPTGSYLLTSRLEPICLSPI

SEQ ID NO: 833500 - protein, 99 aa, Homo sapiens
ARFGSTYTKMERYREDEHGPCARMTRKFVKRSIFFPEFADSDPANIVHDFNKKLTAYLDLNLDKCYVIPLEHFHCYATQKPTGSYLLTSRLEPICLSPI

SEQ ID NO: 833501 - protein, 198 aa, Homo sapiens; identical to SEQ ID NO: 833471

SEQ ID NO: 833502 - protein, 131 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQAGTYLPQSYLIHEHMVITDRIENIDHLGFFIYRLCHDKETYKLQRRGNY

SEQ ID NO: 833503 - protein, 151 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENNVLEGEEVIYRVPSRVRRGPPPVWLSRAIAVRL

SEQ ID NO: 833504 - protein, 519 aa, Homo sapiens
PPPRRSRCRPAGWALRREDPGGAAVPRAMAQSGGEARPGPKTAVQIRVAIQEAEDVDELEDEEEGAETRGAGDPARYLSPGWGSASEEEPSRGHSGTTASGGENEREDLEQEWKPPDEELIKKLVDQIEFYFSDENLEKDAFLLKHVRRNKLGYVSVKLLTSFKKVKHLTRDWRTTAHALKYSVVLELNEDHRKVRRTTPVPLFPNENLPSKMLLVYDLYLSPKLWALATPQKNGRVQEKVMEHLLKLFGTFGVISSVRILKPGRELPPDIRRISSRYSQVGTQECAIVEFEEVEAAIKAHEFMITESQGKENMKAVLIGMKPPKKKPAKDKNHDEEPTASIHLNKSLNKRVEELQYMGDESSANSSSDPESNPTSPMAGRRHAATNKLSPSGHQNLFLSPNASPCTSPWSSPLAQRKGVSRKSPLAEEGRLNCSTSPEIFRKCMDYSSDSSVTPSGSPWVRRRRQAEMGTQEKSPGTSPLLSRKMQTADGLPVGVLRLPRGPDNTRGFHGHERSRACV

SEQ ID NO: 833505 - protein, 491 aa, Homo sapiens
MAQSGGEARPGPKTAVQIRVAIQEAEDVDELEDEEEGAETRGAGDPARYLSPGWGSASEEEPSRGHSGTTASGGENEREDLEQEWKPPDEELIKKLVDQIEFYFSDENLEKDAFLLKHVRRNKLGYVSVKLLTSFKKVKHLTRDWRTTAHALKYSVVLELNEDHRKVRRTTPVPLFPNENLPSKMLLVYDLYLSPKLWALATPQKNGRVQEKVMEHLLKLFGTFGVISSVRILKPGRELPPDIRRISSRYSQVGTQECAIVEFEEVEAAIKAHEFMITESQGKENMKAVLIGMKPPKKKPAKDKNHDEEPTASIHLNKSLNKRVEELQYMGDESSANSSSDPESNPTSPMAGRRHAATNKLSPSGHQNLFLSPNASPCTSPWSSPLAQRKGVSRKSPLAEEGRLNCSTSPEIFRKCMDYSSDSSVTPSGSPWVRRRRQAEMGTQEKSPGTSPLLSRKMQTADGLPVGVLRLPRGPDNTRGFHGHERSRACV

SEQ ID NO: 833506 - protein, 472 aa, Homo sapiens
KCLPVHKSLEQPLGPTQRRFQKVPTGGGRLLNCSTSPEIFRKCMDYSSDSSVTPSGSPWVRRRRQAEYGDPGEKPRYKPLLSRKMQTADGLPLGVLRFPKGPDNFLRILMALDRNRALCIKYLSIFKNKLHWKPYSVVLELNEDHRKVRRTTPVPLFPNENLPSKMLLVYDLYLSPKLWALATPQKNGRVQEKVMEHLLKLFGTFGVISSVRILKPGRELPPDIRRISSRYSQVGTQECAIVEFEEVEAAIKAHEFMITESQGKENMKAVLIGMKPPKKKPAKDKNHDEEPTASIHLNKSLNKRVEELQYMGDESSANSSSDPESNPTSPMAGRRHAATNKLSPSGHQNLFLSPNASPCTSPWSSPLAQRKGVSRKSPLAEEGRLNCSTSPEIFRKCMDYSSDSSVTPSGSPWVRRRRQAEMGTQEKSPGTSPLLSRKMQTADGLPVGVLRLPRGPDNTRGFHGHERSRACV

SEQ ID NO: 833507 - protein, 104 aa, Homo sapiens
MAQSGGEARPGPKTAVQIRVAIQEAEDVDELEDEEEGAETRGAGDPARYLSPGWGSASEEEPSRGHRTAQLPWLESQQVFSLKPFLLPTGIELTPENPWGSSVS

SEQ ID NO: 833508 - protein, 228 aa, Homo sapiens
MAQSGGEARPGPKTAVQIRVAIQEAEDVDELEDEEEGAETRGAGDPARYLSPGWGSASEEEPSRGHSGTTASGGENEREDLEQEWKPPDEELIKKLVDQIEFYFSDENLEKDAFLLKHVRRNKAVRVLLDALKASSSILLTRGAKQCFTTGSVGETNSEQLLLEGYFKCVPWTLEVREPTRKGERTDAPHRGPLVARIETKASPTQECSLVYDSLSCLAKGCGLWACP

SEQ ID NO: 833509 - protein, 491 aa, Homo sapiens; identical to SEQ ID NO: 833505

SEQ ID NO: 833510 - protein, 384 aa, Homo sapiens
PPPRRSRCRPAGWALRREDPGGAAVPRAMAQSGGEARPGPKTAVQIRVAIQEAEDVDELEDEEEGAETRGAGDPARYLSPGWGSASEEEPSRGHSGTTASGGENEREDLEQEWKPPDEELIKKLVDQIEFYFSDENLEKDAFLLKHVRRNKLGYVSVKLLTSFKKVKHLTRDWRTTAHALKYSVVLELNEDHRKVRRTTPVPLFPNENLPSKMLLVYDLYLSPKLWALATPQKNGRVQEKVMEHLLKLFGTFGVISSVRILKPGRELPPDIRRISSRYSQVGTQECAIVEFEEEGRLNCSTSPEIFRKCMDYSSDSSVTPSGSPWVRRRRQAEMGTQEKSPGTSPLLSRKMQTADGLPVGVLRLPRGPDNTRGFHGHERSRACV

SEQ ID NO: 833511 - protein, 122 aa, Homo sapiens
YSGGTHREEGSAGWALRREDPGGAAVPRAMAQSGGEARPGPKTAVQIRVAIQEAEDVDELEDEEEGAETRGAGDPARYLSPGWGSASEEEPSRGHRNRSSVNSRTMLASFIVSSAPSTAPST

SEQ ID NO: 833512 - protein, 579 aa, Homo sapiens
AREKKGRKEGTRKGNKEKGEAGKGNELSGLRQGSWREKVLRRRRSECLAAPPEAQPPDQWSRGAGRGRRRRGGGCGAAAQPPGPESEDSAARPAAVAASPPRPVEPGRPGVASLAWVRGCASGEAEAMDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASAMNQRISQSAPVKQPPPLAPQSPQGGVMGGSNSNQQQQMRLQQLQMEKERLRLKQQELLRQVEELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 833513 - protein, 579 aa, Homo sapiens; identical to SEQ ID NO: 833512

SEQ ID NO: 833514 - protein, 579 aa, Homo sapiens; identical to SEQ ID NO: 833512

SEQ ID NO: 833515 - protein, 579 aa, Homo sapiens; identical to SEQ ID NO: 833512

SEQ ID NO: 833516 - protein, 579 aa, Homo sapiens; identical to SEQ ID NO: 833512

SEQ ID NO: 833517 - protein, 579 aa, Homo sapiens; identical to SEQ ID NO: 833512

SEQ ID NO: 833518 - protein, 290 aa, Homo sapiens
MAKTSSGQRYFLNHIDQTTTWQDPRKAMLSQMNVTAPTSPPVQQNMMNSASAMNQRISQSAPVKQPPPLAPQSPQGGVMGGSNSNQQQQMRLQQLQMEKERLRLKQQELLRQVEAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 833519 - protein, 175 aa, Homo sapiens [sequence omitted]

SEQ ID NO: 833520 - protein, 579 aa, Homo sapiens; identical to SEQ ID NO: 833512

SEQ ID NO: 833521 - protein, 579 aa, Homo sapiens; identical to SEQ ID NO: 833512

SEQ ID NO: 833522 - protein, 129 aa, Homo sapiens
VLQEFGTRSCLCSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 833523 - protein, 368 aa, Homo sapiens
MLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 833524 - protein, 647 aa, Homo sapiens
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 833525 - protein, 647 aa, Homo sapiens; identical to SEQ ID NO: 833524

SEQ ID NO: 833526 - protein, 368 aa, Homo sapiens; identical to SEQ ID NO: 833523

SEQ ID NO: 833527 - protein, 430 aa, Homo sapiens
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 833528 - protein, 647 aa, Homo sapiens; identical to SEQ ID NO: 833524

SEQ ID NO: 833529 - protein, 478 aa, Homo sapiens
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTEARCCWKAGWDFLPLSGEAQVSPVPAKGSSQAL

SEQ ID NO: 833530 - protein, 159 aa, Homo sapiens
AEGVCARAPVFLASPVLLVGRVWWPGHPRSVPAQVLGAHFNPQVRPVSFSCLPDDAFINPHLAKIFERVRQSADFMPLKQMMVRSQGLCPLSVASAPTGWRGQTWGFSRWPRQGMLRAPPWPCPSENSQQRPGPQLAGQVGILRGAALRRRIHWAGALG

SEQ ID NO: 833531 - protein, 142 aa, Homo sapiens
VLQGVGWGQDTAGKPVGGWGSAPGRAHPSPWANSPASPIPPQYPGVAQSINSDVNNLMAVLNMSNMLPEGLRLGGWVKGRSGWQASVLGSGDQRGSSLQSPFLADALLPGPGLFPEHLIDVLRRELALECDYQREAACARKF

SEQ ID NO: 833532 - protein, 647 aa, Homo sapiens; identical to SEQ ID NO: 833524

SEQ ID NO: 833533 - protein, 647 aa, Homo sapiens; identical to SEQ ID NO: 833524

SEQ ID NO: 833534 - protein, 727 aa, Homo sapiens
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRCGPRPGPLRVCTREAEGTMFSSLVKAPPALRGRGLGLQPGPRPYPAWGEGGPSAWLGGVCGGGDGVEGLWLGRDLPPLPRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 833535 - protein, 629 aa, Homo sapiens
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 833536 - protein, 452 aa, Homo sapiens
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTEVLTFDS

SEQ ID NO: 833537 - protein, 119 aa, Homo sapiens
NENSAPRALWEEPGLVEGSGVSPPFILPLLPQVMEDAHLDAILILGEAFASDEPFDFGTQSTTEKIHNLIPVMLRHRLVPPPEETYSLHRKMGGSFLICSKLKARFPCKAMFEEAYSNY

SEQ ID NO: 833538 - protein, 355 aa, Homo sapiens
MADNSSDECEEENNKVLREGMPQAPGHRGKDMDPVPPAPASLKCHQTPSHVLERVGWYRESQKHRKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 833539 - protein, 304 aa, Homo sapiens
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 833540 - protein, 526 aa, Homo sapiens
ALINRRTRTSGDRPSLLSLSAREPAGQHQFRGPQPGTRTTTTKFSQSKNAGPSQGQVPANEGVQLVGGWCGSGHDDRWTGVSSIGSPGDRAQEATLLPEPGAKALCPRPSGRGSSGPCPRPADKEKTTKVVENQTYDERLEINDSEEVASIYTPTPRHQGLPRSAHLPNKAMADNSSDECEEENNKVLREGMPQAPGHRGKDMDPVPPAPASLKCHQTPSHVLERVGWYRESQKHRKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 833541 - protein, 370 aa, Homo sapiens
CFLYSPKKLRWDPICKIRVKVETKVVENQTYDERLEINDSEEVASIYTPTPRHQGLPRSAHLPNKAMADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 833542 - protein, 304 aa, Homo sapiens; identical to SEQ ID NO: 833539

SEQ ID NO: 833543 - protein, 208 aa, Homo sapiens
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPSYKGKKQEHTITHW

SEQ ID NO: 833544 - protein, 304 aa, Homo sapiens; identical to SEQ ID NO: 833539

SEQ ID NO: 833545 - protein, 178 aa, Homo sapiens
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHLKEKPENAKPLRWAL

SEQ ID NO: 833546 - protein, 475 aa, Homo sapiens
ALINRRTRTSGDRPSLLSLSAREPAGQHQFRGPQPGTRTTTTKFSQSKNAGPSQGQVPANEGVQLVGGWCGSGHDDRWTGVSSIGSPGDRAQEATLLPEPGAKALCPRPSGRGSSGPCPRPADKEKTTKVVENQTYDERLEINDSEEVASIYTPTPRHQGLPRSAHLPNKAMADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 833547 - protein, 254 aa, Homo sapiens
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDILSSVV

SEQ ID NO: 833548 - protein, 399 aa, Homo sapiens
MVPFPGHMVDPSPIQPFLPHHPERTIHPSFQNSTPANGISHLGIEPVFHRAALPQREPLPRWLLQPLQHLRFQGDLARIGGLAHLHLASQLQVAGLGARPGRGHVQDGRGAVHGFGQSRLHFGGDQDGRHLLPGLGLSQHVLAAAAGATAKGSAGSRAGAGPEPTRRPPPAAKKKIPRSGNSKQSGERAFGVPGWEWGTGHGAQRVPPGRMLPPGLTPLLGGLSRALGAQGLPPLANFLLGNRGLDAHINLSLHLRSEEAPLEETEAAATHESRSGGYGSEPARERASSQGRKGDSSEGRREEGRKGPKTSPPRGSCHPAREHRSVTRDAAEVRQEPPKGLSWGDSHRCPEGPRTESTLAPAGLHMLRELDRGKAVAVGRGRRDARLAGRAGLRSGAAA

SEQ ID NO: 833549 - protein, 109 aa, Homo sapiens
HESRSGGYGSEPARERASSQGRKGDSSEGRREEGRKGPKTSPPRGSCHPAREHRSVTRDAAEVRQEPPKGLSWGDSHRCPEGPRTESTLAPAGLHMLRELDRGKAVAVG

SEQ ID NO: 833550 - protein, 72 aa, Homo sapiens
GSVWKGRSHQFSSSHLPSPRPVTRATNTRIYHPGRRGLASAAILRQPPPPPPPPQQPAKALGVSSCRPQLVH

SEQ ID NO: 833551 - protein, 1759 aa, Homo sapiens
RACGRLRCQETGVASVWVTSVLLEGGIRVAGPWAATPAGLIASRPPRSSALPSVPPRPTTAWEASSSQPAAQPGSAPQSPTATGRGDTGRAGETRLQDRIAPTLDGAPRPSLPPSPPPSGRIPAPAAAAATAADLEACPSPPTVAPALGRSPFPRWPRRARLLRRGRGGGGVESLPHFGAPVPRARLQLTARRGHAGLRARMREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDHKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 833552 - protein, 1808 aa, Homo sapiens
RACGRLRCQETGVASVWVTSVLLEGGIRVAGPWAATPAGLIASRPPRSSALPSVPPRPTTAWEASSSQPAAQPGSAPQSPTATGRGDTGRAGETRLQDRIAPTLDGAPRPSLPPSPPPSGRIPAPAAAAATAADLEACPSPPTVAPALGRSPFPRWPRRARLLRRGRGGGGVESLPHFGAPVPRARLQLTARRGHAGLRARMREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDHKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFSTRSMPSDARSHGSPAAAAAAAAAVAASRPSPSGGDSVLPKSISSAHDTRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 833553 - protein, 1573 aa, Homo sapiens
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKGVRQISHAVSSSLNEEKMNAPNQPPHKDTGKTVENVEEYSYKQEKKIRAALRTTERDHKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 833554 - protein, 1603 aa, Homo sapiens
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKGVRQISHAVSSSLNEEKMNAPNQPPHKDTGKTVENVEEYSYKQEKKIRAALRTTERDHKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHRSTVTLPNSQEISMSYIISAFSLKLEEFLQNEEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 833555 - protein, 429 aa, Homo sapiens
MPSDARSHGSPAAAAAAAAAVAASRPSPSGGDSVLPKSISSAHDTRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 833556 - protein, 1573 aa, Homo sapiens; identical to SEQ ID NO: 833553

SEQ ID NO: 833557 - protein, 894 aa, Homo sapiens
MKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 833558 - protein, 825 aa, Homo sapiens
CHFIPGRVYLMHLVPGDQLQEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 833559 - protein, 416 aa, Homo sapiens
PSDLELSPEGQVRTSGQADVKAAAKSISSAMIPGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 833560 - protein, 1410 aa, Homo sapiens
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKGVRQISHAVSSSLNEEKMNAPNQPPHKDTGKTVENVEEYSYKQEKKIRAALRTTERDHKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHRSTVTLPNSQEISMSYIISAFSLKLEEFLLKCKL

SEQ ID NO: 833561 - protein, 193 aa, Homo sapiens [sequence omitted]

SEQ ID NO: 833562 - protein, 171 aa, Homo sapiens
VVYRIPHRFAGYEEGCQSLMEYAWGRAAAAMLFCGFIILVICFILSFFALCGPQMLVFLRVIGGLLALAAVFQIISLVIYPVKYTQTFTLHANRAEPIHRFAGMAGCAILMTIALALLEQLPWMSYLSIVAILGFVAFFEVGPGPIPWFIVAELFSQGPRPAAIAVAGFSN

SEQ ID NO: 833563 - protein, 193 aa, Homo sapiens [sequence omitted]

SEQ ID NO: 833564 - protein, 193 aa, Homo sapiens [sequence omitted]

SEQ ID NO: 833565 - protein, 193 aa, Homo sapiens [sequence omitted]

SEQ ID NO: 833566 - protein, 193 aa, Homo sapiens [sequence omitted]

SEQ ID NO: 833567 - protein, 193 aa, Homo sapiens [sequence omitted]

SEQ ID NO: 833568 - protein, 193 aa, Homo sapiens [sequence omitted]

SEQ ID NO: 833569 - protein, 193 aa, Homo sapiens [sequence omitted]

SEQ ID NO: 833570 - protein, 105 aa, Homo sapiens
DIIALAGRGWLQSSDHGQTSSLWWKCSQEGGGSGSYEEGCQSLMEYGECPPPPPSPPPGSPRGRGLQKPPRVMGPHRVGGASAFQNACLGRARAHASDLNQMQQQ

SEQ ID NO: 833571 - protein, 193 aa, Homo sapiens [sequence omitted]

SEQ ID NO: 833572 - protein, 193 aa, Homo sapiens [sequence omitted]

SEQ ID NO: 833573 - protein, 193 aa, Homo sapiens [sequence omitted]

SEQ ID NO: 833574 - protein, 193 aa, Homo sapiens [sequence omitted]

SEQ ID NO: 833575 - protein, 193 aa, Homo sapiens [sequence omitted]

SEQ ID NO: 833576 - protein, 193 aa, Homo sapiens [sequence omitted]

SEQ ID NO: 833577 - protein, 193 aa, Homo sapiens [sequence omitted]

SEQ ID NO: 833578 - protein, 193 aa, Homo sapiens [sequence omitted]

SEQ ID NO: 833579 - protein, 193 aa, Homo sapiens [sequence omitted]

SEQ ID NO: 833580 - protein, 240 aa, Homo sapiens
GSKLRLGTRLGGPSLLEGYLALRLQAAFYGVFQLAIHFAVKMASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKHQRNLGMSMRVERSTLDQVKKRFEVNKKKMEEKQKDYDFEERMKELREEEEKAKAYKKEKQKEKKRRAEEDLTFEEDDEMAAVMGFSGFGSTKKSY

SEQ ID NO: 833581 - protein, 241 aa, Homo sapiens
ETLQSLARLEHKTPSLLEGYLALRLQAAFYGVFQLAIHFAVKMASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKHQRNLGMSMRVERSTLDQVKKRFEVNKKKMEEKQKDYDFEERMKELREEEEKAKAYKKEKQKEKKRRAEEDLTFEEDDEMAAVMGFSGFGSTKKSY

SEQ ID NO: 833582 - protein, 240 aa, Homo sapiens; identical to SEQ ID NO: 833580

SEQ ID NO: 833583 - protein, 240 aa, Homo sapiens; identical to SEQ ID NO: 833580

SEQ ID NO: 833584 - protein, 155 aa, Homo sapiens
GSKLRLGTRLGGPSLLEGYLALRLQAAFYGVFQLAIHFAVKMASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKQRETEGEEKEG

SEQ ID NO: 833585 - protein, 240 aa, Homo sapiens; identical to SEQ ID NO: 833580

SEQ ID NO: 833586 - protein, 290 aa, Homo sapiens
MASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKHQRNLGMSMRVERSTLDQVKKRFEVNKKKMEEKQKDYDFEERMKELREEKKKKKKKKKKKKKKKKKKKKKKKKRRKKKRGGGAIEKSPGGGDQRRATTINVVVKRRGGHRHTREREARININETREEGRGKENSSAGAEEQTEEAQGTTIWGKETHTHGVGVTNTMGNPRHQRGIRGPRRKTTSGRK

SEQ ID NO: 833587 - protein, 99 aa, Homo sapiens
CDDLPSGSSELSPEKRDASVAISCSKIQGDVAQLLLDVAHDFPLGRGGEAVASLSEDLHEVVGQVPASQVQTQDGVWNPRALLPWGLMFLASSEHVTGN

SEQ ID NO: 833588 - protein, 199 aa, Homo sapiens
AFSSPQTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKHQRNLGMSMRVERSTLDQVKKRFEVNKKKMEEKQKDYDFEERMKELREEEEKAKAYKKEKQKEKKRRAEEDLTFEEDDEMAAVMGFSGFGSTKKSY

SEQ ID NO: 833589 - protein, 240 aa, Homo sapiens; identical to SEQ ID NO: 833580

SEQ ID NO: 833590 - protein, 67 aa, Homo sapiens
GSKLRLGTRLGGPSLLEGYLALRLQAAFYGVFQLAIHFAVKMASGSGVGVVSEEEVLRGGEWFFRPE

SEQ ID NO: 833591 - protein, 912 aa, Homo sapiens
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 833592 - protein, 408 aa, Homo sapiens
EFLLSSSSPFSSPSSSSSPPLPILIPLPSPSPGTFPESFYFPSGLSEKEAPGSAAAKLSCCRAASPRPPLPGPAPRRAMSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGGR

SEQ ID NO: 833593 - protein, 832 aa, Homo sapiens
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEDVDLIQYNTYILGCLSSHCTA

SEQ ID NO: 833594 - protein, 114 aa, Homo sapiens
LDRDLESRYAEDAKRGIMVRHYAYSPDYVNSLDVQINKTARQNTTSHSLKLKGPGGASYPSRGACSVIDKPRSTSPRHSAPRHSAPRHRHHDTVHHDTGTTTQAPRHRHHDTGI

SEQ ID NO: 833595 - protein, 95 aa, Homo sapiens
LDRDLESRYAEDAKRGIMVRHYAYSPDYVNSLDVQINKTARQNTTSHSLKLKGPGGASYPSRGACSVIDKPRSTSPPLAQPIYRHLQQTLMKATK

SEQ ID NO: 833596 - protein, 158 aa, Homo sapiens
PAPAGQGRRPLLGRPAFHSRYTRGKVFPSPLPPSSRLLASSAPASAGGAHYARQFRHFAKTKSPRPEGGGGGRRAEREGRGDVSWEGGKCPGHPHPCILLRTPSCPNPGNSSVSPAVEHHAKCGDAERKDYSVLVPCCPRGHSAVGRGTRTYPVRLRI

SEQ ID NO: 833597 - protein, 340 aa, Homo sapiens
MVTLRKRTLKVLTFLVLFIFLTSFFLNYSHTMVATTWFPKQMVLELSENLKRLIKHRPCTCTHCIGQRKLSAWFDERFNQTMQPLLTAQNALLEDDTYRWWLRLQREKKPNNLNDTIKELFRVVPGNVDPMLEKRSVGCRRCAVVGNSGNLRESSYGPEIDSHDFVLRMNKAPTAGFEADVGTKTTHHLVYPESFRELGDNVSMILVPFKTIDLEWVVSAITTGTISHTYIPVPAKIRVKQDKILIYHPAFIKYVFDNWLQGHGRYPSTGILSVIFSMHVCDEVDLYGFGADSKGNWHHYWENNPSAGAFRKTGVHDADFESNVTATLASINKIRIFKGR

SEQ ID NO: 833598 - protein, 340 aa, Homo sapiens; identical to SEQ ID NO: 833597

SEQ ID NO: 833599 - protein, 340 aa, Homo sapiens; identical to SEQ ID NO: 833597

SEQ ID NO: 833600 - protein, 340 aa, Homo sapiens; identical to SEQ ID NO: 833597

SEQ ID NO: 833601 - protein, 340 aa, Homo sapiens; identical to SEQ ID NO: 833597

SEQ ID NO: 833602 - protein, 340 aa, Homo sapiens; identical to SEQ ID NO: 833597

SEQ ID NO: 833603 - protein, 210 aa, Homo sapiens
MLEKRSVGCRRCAVVGNSGNLRESSYGPEIDSHDFVLRMNKAPTAGFEADVGTKTTHHLVYPESFRELGDNVSMILVPFKTIDLEWVVSAITTGTISHTYIPVPAKIRVKQDKILIYHPAFIKYVFDNWLQGHGRYPSTGILSVIFSMHVCDEVDLYGFGADSKGNWHHYWENNPSAGAFRKTGVHDADFESNVTATLASINKIRIFKGR

SEQ ID NO: 833604 - protein, 340 aa, Homo sapiens; identical to SEQ ID NO: 833597

SEQ ID NO: 833605 - protein, 340 aa, Homo sapiens; identical to SEQ ID NO: 833597

SEQ ID NO: 833606 - protein, 340 aa, Homo sapiens; identical to SEQ ID NO: 833597

SEQ ID NO: 833607 - protein, 340 aa, Homo sapiens; identical to SEQ ID NO: 833597

SEQ ID NO: 833608 - protein, 340 aa, Homo sapiens; identical to SEQ ID NO: 833597

SEQ ID NO: 833609 - protein, 192 aa, Homo sapiens [sequence omitted]

SEQ ID NO: 833610 - protein, 248 aa, Homo sapiens
KAFGWSIALNQHKKIHTGEKPYKCEECGKAFSRSRNLTTHRRVHTREKPYKCEDRGRSFGWSTNLNEYKKIHTGDKLYKCKECGKVFKQSSHLNRHEKIHTGKKPYKCKECGKVITSSSSFAKHKRIHTGEKPFKCLECGKAFTSSTTLTKHRRIHTGEKPYTCEECGKAFRQSAILYVHRRIHTGEKPYTCGECGKTFRQSANLYAHKKIHTGEKPYTCGDCGKTFRQSANLYAHKKIHTGDKTIQV

SEQ ID NO: 833611 - protein, 248 aa, Homo sapiens; identical to SEQ ID NO: 833610

SEQ ID NO: 833612 - protein, 109 aa, Homo sapiens
MTQAGQSSGCTALWFPSMLFSLSLLSNLNQIGSSHLDRPHIPGQSAQLFIYQMSSQQLQQQPSANKKAGKIHNTPFANQLNPTQHLAKPFQQILPGRQSGSLTSPFLAC

SEQ ID NO: 833613 - protein, 109 aa, Homo sapiens; identical to SEQ ID NO: 833612

SEQ ID NO: 833614 - protein, 109 aa, Homo sapiens; identical to SEQ ID NO: 833612

SEQ ID NO: 833615 - protein, 109 aa, Homo sapiens
MHRDSCPLDCKVYVGNLGNNGNKTELERAFGYYGPLRSVWVARNPPGFAFVEFEDPRDAADAVRELDGRTLCGCRVRVELSNGEDYRRRSPPPRRRSPRRRSFSRSRSR

SEQ ID NO: 833616 - protein, 109 aa, Homo sapiens; identical to SEQ ID NO: 833612

SEQ ID NO: 833617 - protein, 109 aa, Homo sapiens; identical to SEQ ID NO: 833612

SEQ ID NO: 833618 - protein, 62 aa, Homo sapiens
MATRRNWNGLLATMDHSEVCGLLETTACFVIEIRDHCISQSDETYCGNGLCRNGTLGRAQYM

SEQ ID NO: 833619 - protein, 109 aa, Homo sapiens; identical to SEQ ID NO: 833612

SEQ ID NO: 833620 - protein, 120 aa, Homo sapiens
MHRDSCPLDCKVYVGNLGNNGNKTELERAFGYYGPLRSVWVARNPPGFAFVEFEDPRDAADAVRELDGRTLCGCRVRVELSNGEDYRRRSPPPRRRQVLERKLVKRYWCNGVASRSRYFS

SEQ ID NO: 833621 - protein, 109 aa, Homo sapiens; identical to SEQ ID NO: 833612

SEQ ID NO: 833622 - protein, 150 aa, Homo sapiens
KRRRASFVTFSTGRWRGLPAHSEGFLVLEWKNLYSSLGHEPGWGLPGSWEPQRGADSRVVFEMHRDSCPLDCKVYVGNLGNNGNKTELERAFGYYGPLRSVWVARNPPGFAFVEFEDPRDAADAVRELDGRTLCGCRVRVELSNGEQHTK

SEQ ID NO: 833623 - protein, 481 aa, Homo sapiens
MVMAAKKGPGPGGGVSGGKAEAEAASEVWCRRVRELGGCSQAGNRHCFECAQRGVTYVDITVGSFVCTTCSGLLRGLNPPHRVKSISMTTFTEPEVVFLQSRGNEVCRKIWLGLFDARTSLVPDSRDPQKVKEFLQEKYEKKRWYVPPDQVKGPTYTKGSASTPVQGSIPEGKPLRTLLGDPAPSLSVAASTSSQPVSQSHARTSQARSTQPPPHSSVKKASTDLLADIGGDPFAAPQMAPAFAAFPAFGGQTPSQGGFANFDAFSSGPSSSVFGSLPPAGQASFQAQPTPAGSSQGTPFGATPLAPASQPNSLADVGSFLGPGVPAAGVPSSLFGMAGQVPPLQSVTMGGGGGSSTGLAFGAFTNPFTAPAAQSPLPSTNPFQPNGLAPGPGFGMSSAGPGFPQAVPPTGAFASSFPAPLFPPQTPLVQQQNGSSFGDLGSAKLGQRPLSQPAGISTNPFMTGPSSSPFASKPPTTNPFL

SEQ ID NO: 833624 - protein, 481 aa, Homo sapiens; identical to SEQ ID NO: 833623

SEQ ID NO: 833625 - protein, 393 aa, Homo sapiens
MVMAAKKGPGPGGGVSGGKAEAEAASEVWCRRVRELGGCSQAGNRHCFECAQRGVTYVDITVGSFVCTTCSGLLRGLNPPHRVKSISMTTFTEPEVVFLQSRGNEVCRKIWLGLFDARTSLVPDSRDPQKVKEFLQEKYEKKRWYVPPDQVKGPTYTKGSASTPVQGSIPEGKPLRTLLGDPAPSLSVAASTSSQPVSQSHARTSQARSTQPPPHSSVKKASTDLLADIGGDPFAAPQMAPAFAAFPAFGGQTPSQGGFANFDAFSSGPSSSVFGSLPPAGQASFQAQPTPAGSSQGTPFGATPLAPASQPNSLADVGSFLGPGVPAAGVPSSLFGMAGQVPPLQSVTMGGGGGSSTGLAFGAFTNPFTAPAAQSPLPSTNPFHQLGSPPTPS

SEQ ID NO: 833626 - protein, 201 aa, Homo sapiens
MVMAAKKGPGPGGGVSGGKAEAEAASEVWCRRVRELGGCSQAGNRHCFECAQRGVTYVDITVGSFVCTTCSGLLRGLNPPHRVKSISMTTFTEPEVVFLQSRGNEVCRKIWLGLFDARTSLVPDSRDPQKVKEFLQEKYEKKRWYVPPDQVKGPTYTKGSASTPVQGSIPEGKPLRTLLGDPAPSLSVAASTSSQVTLRSA

SEQ ID NO: 833627 - protein, 155 aa, Homo sapiens
MVMAAKKGPGPGGGVSGGKAEAEAASEVWCRRVRELGGCSQAGNRHCFECAQRGVTYVDITVGSFVCTTCSGLLRGLNPPHRVKSISMTTFTEPEVVFLQSRGNEVCRKIWLGLFDARTSLVPDSRDPQKVKEFLQEKYEKKRWPDTFPRRLCQL

SEQ ID NO: 833628 - protein, 481 aa, Homo sapiens; identical to SEQ ID NO: 833623

SEQ ID NO: 833629 - protein, 236 aa, Homo sapiens [sequence omitted]

SEQ ID NO: 833630 - protein, 161 aa, Homo sapiens
MVMAAKKGPGPGGGVSGGKAEAEAASEVWCRRVRDSTGLAFGAFTNPFTAPAAQSPLPSTNPFQPNGLAPGPGFGMSSAGPGFPQAVPPTGAFASSFPAPLFPPQTPLVQQQNGSSFGDLGSAKLGQRPLSQPAGISTNPFMTGPSSSPFASKPPTTNPFL

SEQ ID NO: 833631 - protein, 223 aa, Homo sapiens
NREAAGDPGLPGLWATGAERARRGAGGSDRRREPAALTARRRTMEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIALRRQRNHPTHLASGGGRRKKETSSYILQSM

SEQ ID NO: 833632 - protein, 290 aa, Homo sapiens
NREAAGDPGLPGLWATGAERARRGAGGSDRRREPAALTARRRTMEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPYENSDLFYAVKPLPRSAISLLNSVNKLRTAVFQVDLSKGSLEP

SEQ ID NO: 833633 - protein, 212 aa, Homo sapiens
RLGTRPGGNRPREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 833634 - protein, 370 aa, Homo sapiens
RLGTRPGGNGRIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLAGRGVFLGVFPPRGGPKIGPGAMVFQMLYADCYMNREEFWEMFDGSLYHKLREKLGCQDAFPEVYDKICKAARH

SEQ ID NO: 833635 - protein, 559 aa, Homo sapiens
NREAAGDPGLPGLWATGAERARRGAGGSDRRREPAALTARRRTMEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 833636 - protein, 559 aa, Homo sapiens; identical to SEQ ID NO: 833635

SEQ ID NO: 833637 - protein, 559 aa, Homo sapiens; identical to SEQ ID NO: 833635

SEQ ID NO: 833638 - protein, 559 aa, Homo sapiens; identical to SEQ ID NO: 833635

SEQ ID NO: 833639 - protein, 559 aa, Homo sapiens; identical to SEQ ID NO: 833635

SEQ ID NO: 833640 - protein, 559 aa, Homo sapiens; identical to SEQ ID NO: 833635

SEQ ID NO: 833641 - protein, 559 aa, Homo sapiens; identical to SEQ ID NO: 833635

SEQ ID NO: 833642 - protein, 355 aa, Homo sapiens
RLGTRPGGNGRIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 833643 - protein, 559 aa, Homo sapiens; identical to SEQ ID NO: 833635

SEQ ID NO: 833644 - protein, 559 aa, Homo sapiens; identical to SEQ ID NO: 833635

SEQ ID NO: 833645 - protein, 95 aa, Homo sapiens
DDYVSELSGCITHLPRMDLLTLAGFLDRGPVLANPCGGTQKAKEPPYPFGLWRGQKKERNLILYFTKHVNSGISSHRRPMCFLAQCKTDDSTCCR

SEQ ID NO: 833646 - protein, 355 aa, Homo sapiens; identical to SEQ ID NO: 833642

SEQ ID NO: 833647 - protein, 355 aa, Homo sapiens; identical to SEQ ID NO: 833642

SEQ ID NO: 833648 - protein, 355 aa, Homo sapiens; identical to SEQ ID NO: 833642

SEQ ID NO: 833649 - protein, 559 aa, Homo sapiens; identical to SEQ ID NO: 833635

SEQ ID NO: 833650 - protein, 142 aa, Homo sapiens
FLLLPPLLCWSPHCTSHELSGASVLPSQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 833651 - protein, 355 aa, Homo sapiens; identical to SEQ ID NO: 833642

SEQ ID NO: 833652 - protein, 142 aa, Homo sapiens; identical to SEQ ID NO: 833650

SEQ ID NO: 833653 - protein, 559 aa, Homo sapiens; identical to SEQ ID NO: 833635

SEQ ID NO: 833654 - protein, 559 aa, Homo sapiens; identical to SEQ ID NO: 833635

SEQ ID NO: 833655 - protein, 559 aa, Homo sapiens; identical to SEQ ID NO: 833635

SEQ ID NO: 833656 - protein, 190 aa, Homo sapiens [sequence omitted]

SEQ ID NO: 833657 - protein, 559 aa, Homo sapiens; identical to SEQ ID NO: 833635

SEQ ID NO: 833658 - protein, 559 aa, Homo sapiens; identical to SEQ ID NO: 833635

SEQ ID NO: 833659 - protein, 559 aa, Homo sapiens; identical to SEQ ID NO: 833635

SEQ ID NO: 833660 - protein, 559 aa, Homo sapiens; identical to SEQ ID NO: 833635

SEQ ID NO: 833661 - protein, 131 aa, Homo sapiens
LVDSMCLNPRQQVLAGVRPESQRNGLCQVDSVLPGCCEGWGASRHSDSAEGTCSLAHLGLCGGGSYRTESDTVQSVNICSHTAHCDTSWRFSVCEYGGHRVLPCPLSPAVLHVCISTCVLDSEVAYIHSAS

SEQ ID NO: 833662 - protein, 389 aa, Homo sapiens
NREAAGDPGLPGLWATGAERARRGAGGSDRRREPAALTARRRTMEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQVRLGFL

SEQ ID NO: 833663 - protein, 465 aa, Homo sapiens
RRLSPPRQLPYTEPHSLAPPPPSLGAPPPPSGKKSTPNHSNPREASFHPWGDELSTVTSSSSPPKPPSPPPAPTPFWRRVKGPFKATAPSSGQTTGGDDHGSMADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKGTIT

SEQ ID NO: 833664 - protein, 1459 aa, Homo sapiens
RRLSPPRQLPYTEPHSLAPPPPSLGAPPPPSGKKSTPNHSNPREASFHPWGDELSTVTSSSSPPKPPSPPPAPTPFWRRVKGPFKATAPSSGQTTGGDDHGSMADTDLFMECEEEELEPWQKISDVIEDSVVEDYNSVDKTTTAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 833665 - protein, 1512 aa, Homo sapiens
RRLSPPRQLPYTEPHSLAPPPPSLGAPPPPSGKKSTPNHSNPREASFHPWGDELSTVTSSSSPPKPPSPPPAPTPFWRRVKGPFKATAPSSGQTTGGDDHGSMADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 833666 - protein, 1477 aa, Homo sapiens
GVSLPRASSRTRSRIPWPPHPPPSGPPRPPREKNPPRITRTRGRLPFTLGETSFQRLPLLRLPPSPRPLPLLPPPSGAGCKVPLRRRRLPRVQTTGGDDHGSMADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVLLPKKWLNTRRKESPWIQNPVSHQQQSPHPLRKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 833667 - protein, 1244 aa, Homo sapiens
MNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 833668 - protein, 1010 aa, Homo sapiens
MVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 833669 - protein, 1010 aa, Homo sapiens; identical to SEQ ID NO: 833668

SEQ ID NO: 833670 - protein, 1512 aa, Homo sapiens; identical to SEQ ID NO: 833665

SEQ ID NO: 833671 - protein, 1512 aa, Homo sapiens; identical to SEQ ID NO: 833665

SEQ ID NO: 833672 - protein, 1512 aa, Homo sapiens; identical to SEQ ID NO: 833665

SEQ ID NO: 833673 - protein, 1454 aa, Homo sapiens
SDDRKENALQTVGTGEPWCDVVLAILADGTVLPTLVFYRGQMDQPANMPDSILLEAKELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 833674 - protein, 1002 aa, Homo sapiens
QKIVVIKGSDEPALLCNISATEVGRSSTSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 833675 - protein, 1512 aa, Homo sapiens; identical to SEQ ID NO: 833665

SEQ ID NO: 833676 - protein, 434 aa, Homo sapiens
SDDRKENALQTVGTGEPWCDVVLAILADGTVLPTLVFYRGQMDQPANMPDSILLEAKELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLGKASEEEMAEPGWDGGWRTDDYHLVTVAPSFPSPPAVSIASFVTVKRPGVTGENSNEVAKLVNTLNTIPSLGQSPGPVVVSNNSSAHGSQRTSGPESSMKGTIT

SEQ ID NO: 833677 - protein, 907 aa, Homo sapiens
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNEGSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 833678 - protein, 907 aa, Homo sapiens; identical to SEQ ID NO: 833677

SEQ ID NO: 833679 - protein, 907 aa, Homo sapiens; identical to SEQ ID NO: 833677

SEQ ID NO: 833680 - protein, 881 aa, Homo sapiens
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNEGSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLQYL

SEQ ID NO: 833681 - protein, 527 aa, Homo sapiens
LWGNIDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 833682 - protein, 481 aa, Homo sapiens
GDAARSARETRRRWQKRRRRAAGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 833683 - protein, 550 aa, Homo sapiens
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNEGSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAAESAALGSSRRG

SEQ ID NO: 833684 - protein, 194 aa, Homo sapiens
LEDPNAADSAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAAESAALGSSRRG

SEQ ID NO: 833685 - protein, 907 aa, Homo sapiens; identical to SEQ ID NO: 833677

SEQ ID NO: 833686 - protein, 813 aa, Homo sapiens
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNEGSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKNKELYLQPVQFLLLPGPHRLDNLEQDLECLLLGQACP

SEQ ID NO: 833687 - protein, 551 aa, Homo sapiens
LEDPNAADSAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 833688 - protein, 481 aa, Homo sapiens
SFYSFNFCCFKNRTQDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 833689 - protein, 196 aa, Homo sapiens
MICLVLTIFANLFPAGEPRGAGRGRVAGAGPASRPVPACPAACTGAHERTFLAVKPDGVQRRLVGEIVRRFERKGFKLVALKLVQRASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 833690 - protein, 165 aa, Homo sapiens
MVARLGGRPAACTGAHERTFLAVKPDGVQRRLVGEIVRRFERKGFKLVALKLVQRASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 833691 - protein, 226 aa, Homo sapiens
GDLASAAALRPPTAAGFRGASEAASPRRPQRPDQASLSAGPAPGATAPPRGSRSRTAIMICLVLTIFANLFPAACTGAHERTFLAVKPDGVQRRLVGEIVRRFERKGFKLVALKLVQRGAVSERGRGVGGRGAGTWGRLGAGCGRRRPDPSAGPPRSCCVSTTPSCVNARSTAALSSIWPPGRWWPWFGRGWTWCAPRGRSSEPRTRPTPRPAPSAGISASRLART

SEQ ID NO: 833692 - protein, 174 aa, Homo sapiens
MICLVLTIFANLFPAGEPRGAGRGLGGRCWAGLTARPRLPRSLHRRTRTHLPGREAGRRAAAAGASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 833693 - protein, 287 aa, Homo sapiens
GDLASAAALRPPTAAGFRGASEAASPRRPQRPDQASLSAGPAPGATAPPRGSRSRTAIMICLVLTIFANLFPAACTGAHERTFLAVKPDGVQRRLVGEIVRRFERKGFKLVALKLVQRGAVSERGRGVGGRGAGTWGRLGAGCGRRRPDPSAGPPRSCCVSTTPSCVNARSTAALSSIWPPGRWWPWSSIREAGGRLRDPHPRVIPRPFLRTGLAGAGRGAHLAGAHRSHEPGRRPARHHPRGFLHRGWQEPDSRQRLGGECPPRDRSLVPRRRAPLLGGQRWALAV

SEQ ID NO: 833694 - protein, 228 aa, Homo sapiens
GDLASAAALRPPTAAGFRGASEAASPRRPQRPDQASLSAGPAPGATAPPRGSRSRTAIMICLVLTIFANLFPAACTGAHERTFLAVKPDGVQRRLVGEIVRRFERKGFKLVALKLVQRASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 833695 - protein, 165 aa, Homo sapiens; identical to SEQ ID NO: 833690

SEQ ID NO: 833696 - protein, 90 aa, Homo sapiens
GDLASAAALRPPTAAGFRGASEAASPRRPQRPDQASLSAGPAPGATAPPRGSRSRTAIMICLVLTIFANLFPAGEPRGAGRGRVAGAGPA

SEQ ID NO: 833697 - protein, 109 aa, Homo sapiens
MASGPVVAMVSIREAGGRLRDPHPRVIPRPFLRTGLAGAGRGAHLAGAHRSHEPGRRPARHHPRGFLHRGWQEPDSRQRLGGECPPRDRSLVPRRRAPLLGGQRWALAV

SEQ ID NO: 833698 - protein, 104 aa, Homo sapiens
MSTHSRPPTGESRGRMRATNARHVDANSTPARGEPDDADSVWVRPHLRGVIYTRRWMTKKGSTHDARIKLGTDTLACAKVTTKPAADHRRHGRRRPPYPPPPLL

SEQ ID NO: 833699 - protein, 67 aa, Homo sapiens
YVCDKAVLIVTLCALRETLMRKKVLQNLNFGRVHYQRQMKNHRKKNLMSIFRICFYETRERSLRSLM

SEQ ID NO: 833700 - protein, 315 aa, Homo sapiens
MHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLRNSDEEESASESELWKGPLPETDEKSQEEEFDEYFQDLFL

SEQ ID NO: 833701 - protein, 382 aa, Homo sapiens
GTRRERRVAGGGGGGGGGGGCGEAVRQGARDLSCSGSLRPWVVAAAAGKEGNDDSGGELGTQGGRERMHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLRNSDEEESASESELWKGPLPETDEKSQEEEFDEYFQDLFL

SEQ ID NO: 833702 - protein, 369 aa, Homo sapiens
GTRRERRVAGGGGGGGGGGGCGEAVRQGARDLSCSGSLRPWVVAAAAGKEGNDDSGGELGTQGGRERMHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLRNSDEEESASESELWKGPLPETDEKSQ

SEQ ID NO: 833703 - protein, 382 aa, Homo sapiens; identical to SEQ ID NO: 833701

SEQ ID NO: 833704 - protein, 369 aa, Homo sapiens; identical to SEQ ID NO: 833702

SEQ ID NO: 833705 - protein, 725 aa, Homo sapiens
MAVIESGILFSRLKFYHLYVDALEYKMPSPTFAIFARIGVRIDSVRSKVQTHMLIQGSESNRKKARTTVTNQCCFIFMLCLTKGHSVLTGHICAIFFFRLIIIIGEELSANVTTLGVIVLLSDNFDSIFKFLVDYIQVIYLKHIYFVIFNKMSLLFLLILKVIHAHCLKYKQFENFKIESKSIPGPQVISSVKFGWLLQTYNTYIKLHVCISCAYVFNISIILCILFVTFEKFDIEWTFFYCSTYRYANVFKQLYEYLFNQSLIPNWWGIEVFCCCCYTVCIFVHMYQRCLFMYVSNQIPKSSIAGQRVMRFKLIYIARFFSRKRFTEFSLPAMCENASFFPETGFFSLCNQHWFFKMSDNFFENNLTELVLHTSSVLKVANPNVNMFSTNVNLNLRVFCVTKKKKKLDQRQLLLQEIIDLQELILDIATLTQCNLEKFRGDLKSLAFLLRFFGNPWLIYICFKRIYCTCESELNFQRVIKVEAELNKKLIVLANNSKCALSIIGFYKSSFLNEQETLMRKKVLQNLNFGRVHYQRQMKNHSEVLILIEICTFSISLGSYNHSFINGKIQHHGDLFNAKDCLAWYRLELIPSHCHKQPTHPASSWKINLSSVHFNRRTSGPCLDFFRDGCFLSFQRSLFHHTVIIINLCKGIPCMGSTLLYCYPTGLLKSKIIIFTVTNTLYIYYAQCSKKNYSLRRFTQFPLVIPQYNLGLHFSLKIVSFLFTS

SEQ ID NO: 833706 - protein, 548 aa, Homo sapiens
MNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 833707 - protein, 611 aa, Homo sapiens
MLENYRNLVSVEHQLSKPDVVSQLEEAEDFWPVERGIPQDTIPEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 833708 - protein, 338 aa, Homo sapiens
MASRLPTAWSCEPVTFEDVTLGFTPEEWGLLDLKQKSLYREVMLENYRNLVSVEHQLSKPDVVSQLEEAEDFWPVERGIPQDTIPEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETPLKHICDH

SEQ ID NO: 833709 - protein, 621 aa, Homo sapiens
MASRLPTAWSCEPVTFEDVTLGFTPEEWGLLDLKQKSLYREVMLENYRNLVSVEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 833710 - protein, 653 aa, Homo sapiens
MASRLPTAWSCEPVTFEDVTLGFTPEEWGLLDLKQKSLYREVMLENYRNLVSVEHQLSKPDVVSQLEEAEDFWPVERGIPQDTIPEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 833711 - protein, 630 aa, Homo sapiens
EVLTELTVLGLSCFGDLLRDTNPGPQEFYWEHQLSKPDVVSQLEEAEDFWPVERGIPQDTIPEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 833712 - protein, 952 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 833713 - protein, 952 aa, Homo sapiens; identical to SEQ ID NO: 833712

SEQ ID NO: 833714 - protein, 962 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPAEDQPDSALPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 833715 - protein, 952 aa, Homo sapiens; identical to SEQ ID NO: 833712

SEQ ID NO: 833716 - protein, 752 aa, Homo sapiens
PRLVPPRWLSSTQALAFGVRRAPADWTGAVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 833717 - protein, 344 aa, Homo sapiens
SSQACVIGRGDSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 833718 - protein, 269 aa, Homo sapiens
PESSKSSGTLSSREQNSASSCASPGWAYEPAPSHSSPVCLCAHPPCRFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 833719 - protein, 270 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLCCSAPTRPLPGCPEGWMPAGPRASLGTQENSQDLGDSKS

SEQ ID NO: 833720 - protein, 151 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGTHYV

SEQ ID NO: 833721 - protein, 952 aa, Homo sapiens; identical to SEQ ID NO: 833712

SEQ ID NO: 833722 - protein, 952 aa, Homo sapiens; identical to SEQ ID NO: 833712

SEQ ID NO: 833723 - protein, 952 aa, Homo sapiens; identical to SEQ ID NO: 833712

SEQ ID NO: 833724 - protein, 939 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHSSRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 833725 - protein, 614 aa, Homo sapiens
ASKLGSRTRQERVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 833726 - protein, 952 aa, Homo sapiens; identical to SEQ ID NO: 833712

SEQ ID NO: 833727 - protein, 948 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLFTGLGRF

SEQ ID NO: 833728 - protein, 152 aa, Homo sapiens
RSPPRLLLPGVQGPAAAMSGSFELSVQDLNDLLSDGSGCYSLPSQPCNEVTPRIYVGNASVAQDIPKLQKLGITHVLNAAEGRSFMHVNTNANFYKDSSDLVMIEVQSGEYLGEDDIVRFDDIYAVRPPTCKNDMLYLTDHPDPYRREISMS

SEQ ID NO: 833729 - protein, 275 aa, Homo sapiens
ICDQLGKLLQGGRNDPQVPQPFMLRHLSGWRNTKVGIVLTLGNDLEEVGKRSPGRFQPLGQKPGWKALEIGKKKTERLDPPHTQPACMAEVELRSPGDSGFMFFALVLLCLRGRCPHSSASDSQTLNYVGNASVAQDIPKLQKLGITHVLNAAEGRSFMHVNTNANFYKDSGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 833730 - protein, 202 aa, Homo sapiens
RSPPRLLLPGVQGPAAAMSGSFELSVQDLNDLLSDGSGCYSLPSQPCNEVTPRIYVGNASVAQDIPKLQKLGITHVLNAAEGRSFMHVNTNANFYKDSGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 833731 - protein, 113 aa, Homo sapiens
SSSVPSRPQGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 833732 - protein, 202 aa, Homo sapiens; identical to SEQ ID NO: 833730

SEQ ID NO: 833733 - protein, 202 aa, Homo sapiens; identical to SEQ ID NO: 833730

SEQ ID NO: 833734 - protein, 235 aa, Homo sapiens
ICDQLGKLLQGGRNDPQVPQPFMLRHLSGWRNTKVGIVLTLGNDLEEVGKRSPGRFQPLGQKPGWKALEIGKKKTERLDPPHTQPACMAEVERGVLETLASCSLLLFFCASGVAAHIVQRLSQTLNYVGNASVAQDIPKLQKLGITHVLNAAEGRSFMHVNTNANFYKDSGITYLGIKANDTQEFNLSAYFERAADFIDQALAQKNGKGPPTRKRWEAALTGLSLWKTGPQQVSS

SEQ ID NO: 833735 - protein, 202 aa, Homo sapiens; identical to SEQ ID NO: 833730

SEQ ID NO: 833736 - protein, 202 aa, Homo sapiens; identical to SEQ ID NO: 833730

SEQ ID NO: 833737 - protein, 115 aa, Homo sapiens
TGWYPAVDIDRPRRSGGRASQKRGQKTSREVKGPRHTPCPLQVALTALWCQHGIPEVTQPGRHETWRSVQMDPLLVVEQKNPNTINLSKDFLRMILECTSPHMCMHICQNIRVLF

SEQ ID NO: 833738 - protein, 157 aa, Homo sapiens
CVRDYKDRVNVLFMSVAQDIPKLQKLGITHVLNAAEGRSFMHVNTNANFYKDSGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 833739 - protein, 127 aa, Homo sapiens
AALRLACSCRACRAPPPPCRARSSSRCRISTTCSRTAAAATASRASPATRSPRGSTWATRRVLVHCREGYSRSPTLVIAYLMMRQKMDVKSALSIVRQNREIGPNDGFLAQLCQLNDRLAKEGKLKP

SEQ ID NO: 833740 - protein, 187 aa, Homo sapiens
VAFCEEFGANLPHAAVAAGTLAGFSWSGGGGNMAETAAGVGRFKTNYAVERKIEPFYKGGKAQVTSLGKGSGAGSQRPRGVLNVAWLRPLCPLDQTGQHLFCVCGTRVNILEVASGAVLRSLEQEDQEDITAFDLSPDNEVLVTASRALLLAQWAWQEGSVTRLWKAIHTAPVATMAFDPTSTLLAT

SEQ ID NO: 833741 - protein, 76 aa, Homo sapiens
MAFDPTSTLLATGGCDGAVRVWDIVRHYGTHHFRGSPGVVHLVAFHPDPTRLLLFSSATDAAIRVWSLRTGHAWLC

SEQ ID NO: 833742 - protein, 602 aa, Homo sapiens
VAFCEEFGANLPHAAVAAGTLAGFSWSGGGGNMAETAAGVGRFKTNYAVERKIEPFYKGGKAQLDQTGQHLFCVCGTRVNILEVASGAVLRSLEQEDQEDITAFDLSPDNEVLVTASRALLLAQWAWQEGSVTRLWKAIHTAPVATMAFDPTSTLLATGGCDGAVRVWDIVRHYGTHHFRGSPGVVHLVAFHPDPTRLLLFSSATDAAIRVWSLQDRSCLAVLTAHYSAVTSLAFSADGHTMLSSGRDKICIIWDLQSCQATRTVPVFESVEAAVLLPEEPVSQLGVKSPGLYFLTAGDQGTLRVWEAASGQCVYTQAQPPGPGQELTHCTLAHTAGVVLTATADHNLLLYEARSLRLQKQFAGYSEEVLDVRFLGPEDSHVVVASNSPCLKVFELQTSACQILHGHTDIVLALDVFRKGWLFASCAKDQSVRIWRMNKAGQVMCVAQGSGHTHSVGTVCCSRLKESFLVTGSQDCTVKLWPLPKALLSKNTAPDNGPILLQAQTTQRCHDKDINSVAIAPNDKLLATGSQDRTAKLWALPQCQLLGVFSGHRRGLWCVQFSPMDQVLATASADGTIKLWALQDFSCLKVSGAPDPPHFPPW

SEQ ID NO: 833743 - protein, 92 aa, Homo sapiens
VAFCEEFGANLPHAAVAAGTLAGFSWSGGGGNMAETAAGVGRFKTNYAVERKIEPFYKGGKAQLDQTGQHLFCPRGHHGLRPHLHSASHRWL

SEQ ID NO: 833744 - protein, 103 aa, Homo sapiens
GAEYDVTLRAALHADPAVRRAGLLALYTCGIEGRARVPAMAEAASPAIVRQADEHGTRRGPTKAFDPSSTLLPQVAVMGPCASGTSCGTTGHTTSEARPVSCT

SEQ ID NO: 833745 - protein, 169 aa, Homo sapiens
LVTASRALLLAQWAWQEGSVTRLWKAIHTAPVATMAFDPTSTLLATGRALPCRWVVGTDAGALGIPPPHLASPQVAVMGPCASGTSCGTTGHTTSEARPVSCSELEGGGGGQRHHPGCTAHPSCPVRPQPSGLPPGPYTPAALLLGHGCRHPRVVTAGPVMPGCADCPL

SEQ ID NO: 833746 - protein, 260 aa, Homo sapiens
VAFCEEFGANLPHAAVAAGTLAGFSWSGGGGNMAETAAGVGRFKTNYAVERKIEPFYKGGKAQLDQTGQHLFCVCGTRVNILEVASGAVLRSLEQEDQEDITAFDLSPDNEVLVTASRALLLAQWAWQEGSVTRLWKAIHTAPVATMAFDPTSTLLATGGCDGAVRVWDIVRHYGTHHFRGSPGVVHLVAFHPDPTRLLLFSSATDAAIRVWSLQDRSCWWVMHKALTYGLRRGKQVKSGTDWSLGLSGARTAGWNGSGV

SEQ ID NO: 833747 - protein, 840 aa, Homo sapiens
VAFCEEFGANLPHAAVAAGTLAGFSWSGGGGNMAETAAGVGRFKTNYAVERKIEPFYKGGKAQLDQTGQHLFCVCGTRVNILEVASGAVLRSLEQEDQEDITAFDLSPDNEVLVTASRALLLAQWAWQEGSVTRLWKAIHTAPVATMAFDPTSTLLATGGCDGAVRVWDIVRHYGTHHFRGSPGVVHLVAFHPDPTRLLLFSSATDAAIRVWSLQDRSCLAVLTAHYSAVTSLAFSADGHTMLSSGRDKICIIWDLQSCQATRTVPVFESVEAAVLLPEEPVSQLGVKSPGLYFLTAGDQGTLRVWEAASGQCVYTQAQPPGPGQELTHCTLAHTAGVVLTATADHNLLLYEARSLRLQKQFAGYSEEVLDVRFLGPEDSHVVVASNSPCLKVFELQTSACQILHGHTDIVLALDVFRKGWLFASCAKDQSVRIWRMNKAGQVMCVAQGSGHTHSVGTVCCSRLKESFLVTGSQDCTVKLWPLPKALLSKNTAPDNGPILLQAQTTQRCHDKDINSVAIAPNDKLLATGSQDRTAKLWALPQCQLLGVFSGHRRGLWCVQFSPMDQVLATASADGTIKLWALQDFSCLKTFEGHDASVLKVAFVSRGTQLLSSGSDGLVKLWTIKNNECVRTLDAHEDKVWGLHCSRLDDHALTGASDSRVILWKDVTEAEQAEEQARQEEQVVRQQELDNLLHEKRYLRALGLAISLDRPHTVLTVIQAIRRDPEACEKLEATMLRLRRDQKEALLRFCVTWNTNSRHCHEAQAVLGVLLRREAPEELLAYEGVRAALEALLPYTERHFQRLSRTLQAAAFLDFLWHNMKLPVPAAAPTPWETHKGALP

SEQ ID NO: 833748 - protein, 81 aa, Homo sapiens
VAFCEEFGANLPHAAVAAGTLAGFSWSGGGGNMAETAAGVGRFKTNYAVERKIEPFYKGGKAQVPAWGRAAGRAARGRGGC

SEQ ID NO: 833749 - protein, 100 aa, Homo sapiens
SLTRCIGAVGHLVAPPGEKGAGIPANGASIGLNATNEHSDEDEDDHMLHGRMQEACTDVDRSDVKGMDCMECLQAIYAIRGSYPRCAPWGSTQSMHAHGT

SEQ ID NO: 833750 - protein, 149 aa, Homo sapiens
ESLVQPCFYRFLGCFGIAFAKAMHGYSSVIAPRAHGLSLLCTKCVELALRTSCRGCLFNSGHFCFPGGESRKHLESLDSENFMLLSGICACMCVCACVCMRACMCISMICSSAFSQVIFLNCMIYCLLCKCNRLTQQLVHNLPPSTQPS

SEQ ID NO: 833751 - protein, 206 aa, Homo sapiens
MRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNGVLDELPKKCDTIVRSFST

SEQ ID NO: 833752 - protein, 113 aa, Homo sapiens
MDSPLGCQLYPGSDHCNLRADRLCNFLWTASHWLYYSNCPPGIQASLFQGYGTGAYDTTTATVTTTQASYAAQSAYGTQPAYSAQHTSSNSSSRHHRQYLQMGNRPAAKVCIC

SEQ ID NO: 833753 - protein, 203 aa, Homo sapiens
MRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 833754 - protein, 203 aa, Homo sapiens; identical to SEQ ID NO: 833753

SEQ ID NO: 833755 - protein, 203 aa, Homo sapiens; identical to SEQ ID NO: 833753

SEQ ID NO: 833756 - protein, 203 aa, Homo sapiens; identical to SEQ ID NO: 833753

SEQ ID NO: 833757 - protein, 203 aa, Homo sapiens; identical to SEQ ID NO: 833753

SEQ ID NO: 833758 - protein, 203 aa, Homo sapiens; identical to SEQ ID NO: 833753

SEQ ID NO: 833759 - protein, 203 aa, Homo sapiens; identical to SEQ ID NO: 833753

SEQ ID NO: 833760 - protein, 203 aa, Homo sapiens; identical to SEQ ID NO: 833753

SEQ ID NO: 833761 - protein, 203 aa, Homo sapiens; identical to SEQ ID NO: 833753

SEQ ID NO: 833762 - protein, 203 aa, Homo sapiens; identical to SEQ ID NO: 833753

SEQ ID NO: 833763 - protein, 203 aa, Homo sapiens; identical to SEQ ID NO: 833753

SEQ ID NO: 833764 - protein, 203 aa, Homo sapiens; identical to SEQ ID NO: 833753

SEQ ID NO: 833765 - protein, 181 aa, Homo sapiens
MRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTDALVRLLLLCNGVYSRV

SEQ ID NO: 833766 - protein, 203 aa, Homo sapiens; identical to SEQ ID NO: 833753

SEQ ID NO: 833767 - protein, 122 aa, Homo sapiens
MRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAVYLPCARDVPDQS

SEQ ID NO: 833768 - protein, 203 aa, Homo sapiens; identical to SEQ ID NO: 833753

SEQ ID NO: 833769 - protein, 91 aa, Homo sapiens
MRWKALIEMEKQQQDQVDRNIKEAREKLEMEMEAARHEHQVMLMRQDLMRRQEELRRMEELHNQEVQKRKQLELSREEEPTAREDSSRRSG

SEQ ID NO: 833770 - protein, 106 aa, Homo sapiens
MRWKALIEMEKQQQDQVDRNIKEAREKLEMEMEAARHEHQVMLMRQVCEGQEKFGVGKRTPSGKEALGAGTGREQIGPQKMATVGRHTVQNTGTRECNKTPLRHHQ

SEQ ID NO: 833771 - protein, 244 aa, Homo sapiens
PSNTSSPSDCYYGPEDPQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 833772 - protein, 184 aa, Homo sapiens
VSKDPVFRCHGHTAACSTRPEQKMSLPSLGLDLYAIRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 833773 - protein, 117 aa, Homo sapiens
MRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 833774 - protein, 119 aa, Homo sapiens
LCHKVVTWNNTSPVRKYSWGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 833775 - protein, 203 aa, Homo sapiens; identical to SEQ ID NO: 833753

SEQ ID NO: 833776 - protein, 473 aa, Homo sapiens
MSLTSLMGEDCHQVMLMRQDLMRRQEELRRMEELHNQEVQKRKQLELRQEEERRRREEEMRRQQEEMMRRQQEGFKGTFPDAREQEILDWVQTVLCGRCYWALNTHECASAPSARCAQAGTTMLTPWSLTTSDDRMRTLADLTHTKQLDTLYGSVLLPTAKRISRAHLRGNLQLLTYQTCARSMDDCNFDPQTKASADYLTNACTLSLAFSVNKRVNNEGALILRLAQQFIPCETQRSAAYHFAKLRYYPDLLLTLGEYACEDSSVPRAVVWHLDQRYNSWCGNHRHNSDYMMNGQSPESLYLVDCLKNTATKPTVTSSNQPYTPRYTCTHTAKYLNNMGATPVSKYAMSNKPRGKKRDINHNHTPRRRTCTERINPSNNIRKLFIPTAATAHHTNQLNTHYHPKLTHHQHHNTRSYHIYPTQHTKYTSHSHKRLKHIQTYNSPLHSPYHHHTTTNIQQPQTNSQYDNHSCYT

SEQ ID NO: 833777 - protein, 203 aa, Homo sapiens; identical to SEQ ID NO: 833753

SEQ ID NO: 833778 - protein, 122 aa, Homo sapiens; identical to SEQ ID NO: 833767

SEQ ID NO: 833779 - protein, 117 aa, Homo sapiens; identical to SEQ ID NO: 833773

SEQ ID NO: 833780 - protein, 203 aa, Homo sapiens; identical to SEQ ID NO: 833753

SEQ ID NO: 833781 - protein, 203 aa, Homo sapiens; identical to SEQ ID NO: 833753

SEQ ID NO: 833782 - protein, 203 aa, Homo sapiens; identical to SEQ ID NO: 833753

SEQ ID NO: 833783 - protein, 203 aa, Homo sapiens; identical to SEQ ID NO: 833753

SEQ ID NO: 833784 - protein, 203 aa, Homo sapiens; identical to SEQ ID NO: 833753

SEQ ID NO: 833785 - protein, 206 aa, Homo sapiens; identical to SEQ ID NO: 833751

SEQ ID NO: 833786 - protein, 160 aa, Homo sapiens
MRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLL

SEQ ID NO: 833787 - protein, 203 aa, Homo sapiens; identical to SEQ ID NO: 833753

SEQ ID NO: 833788 - protein, 203 aa, Homo sapiens; identical to SEQ ID NO: 833753

SEQ ID NO: 833789 - protein, 90 aa, Homo sapiens
MRWKALIEMEKQQQDQVDRNIKEAREKLEMEMEAARHEHQVMLMRQDLMRRQEELRRMEELHNQCGTAYRPSTRTRARDRRRAPEVVVAA

SEQ ID NO: 833790 - protein, 203 aa, Homo sapiens; identical to SEQ ID NO: 833753

SEQ ID NO: 833791 - protein, 203 aa, Homo sapiens; identical to SEQ ID NO: 833753

SEQ ID NO: 833792 - protein, 169 aa, Homo sapiens
GLCAARRWLFVLAAVHMACLHCNHRLGCSQDLVSLEDRSDVWPIQSFRPCLKLVSYVNLKNKMHFYPTLPAREKLEMEMEAARHEHQVMLMRQDLMRRQEELRRMEELHNQEVQKRKQLELRQEEERRRREEEMRRQQEEMMRRQQEGFKGTFPDAVYLPCARDVPDQS

SEQ ID NO: 833793 - protein, 186 aa, Homo sapiens
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833794 - protein, 322 aa, Homo sapiens
SRPSAGPLPHHRDVGRPRGLEKRPSPARQSPAPPRPRARSTPPCSPGARGASSSPARSAGPPLRGGVGSGGGRSLRGLARAGGRCPAGASGFRPRYEGRGRGCCGRVRLLRRGLHVDCGKLGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833795 - protein, 322 aa, Homo sapiens; identical to SEQ ID NO: 833794

SEQ ID NO: 833796 - protein, 252 aa, Homo sapiens
AGFSLLLSFLLRRLVTLISQQATLLASNEAFKKQAESAVRRRGLHVDCGKLGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833797 - protein, 186 aa, Homo sapiens; identical to SEQ ID NO: 833793

SEQ ID NO: 833798 - protein, 186 aa, Homo sapiens; identical to SEQ ID NO: 833793

SEQ ID NO: 833799 - protein, 217 aa, Homo sapiens
AFFPIVLNGCQIRELQATEADFAWAIRPLEKSTKLDFHFAQGPRARVCAFSSTPVLFVFFSRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833800 - protein, 182 aa, Homo sapiens
KVRLGTRPGVVIGRGVVLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833801 - protein, 134 aa, Homo sapiens
VVRPLVRDQSVDRARVLPRRYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833802 - protein, 322 aa, Homo sapiens; identical to SEQ ID NO: 833794

SEQ ID NO: 833803 - protein, 322 aa, Homo sapiens; identical to SEQ ID NO: 833794

SEQ ID NO: 833804 - protein, 322 aa, Homo sapiens; identical to SEQ ID NO: 833794

SEQ ID NO: 833805 - protein, 322 aa, Homo sapiens; identical to SEQ ID NO: 833794

SEQ ID NO: 833806 - protein, 300 aa, Homo sapiens
SRPSAGPLPHHRDVGRPRGLEKRPSPARQSPAPPRPRARSTPPCSPGARGASSSPARSAGPPLRGGVGSGGGRSLRGLARAGGRCPAGASGFRPRYEGRGRGCCGRVRLLRRGLHVDCGKLGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKKRTGA

SEQ ID NO: 833807 - protein, 139 aa, Homo sapiens
RTRGSTHASVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833808 - protein, 190 aa, Homo sapiens
MGAEASSSWCPGTALPEERLSVKRASEISGFLGQGSSGEAALDVLTHVLEGAGNKLTSSCGKPSSNRMSLQWTAVATFLYAEVFVVLLLCIPFISPKRWQKIFKSRLVELLVSYGNTPASPSSTSVCALLLPPFPSTAHSSSSRPLSTLSKHITGDLIATRSECVCCHPAWPGQAWHSLGLPRLSVESTS

SEQ ID NO: 833809 - protein, 145 aa, Homo sapiens
KVRLGTRPGCVIGRGARGASSSPARSAGPPLRGGVGSGGGRSLRGLARAGGRCPAGASGFRPRYEGRGRGCCGRVRLLRRGLHVDCGKLGERAPRAGLGSGTAEAPRPIDEGERRAARGGPGAGESRGPQPTCVKQAHIFLWETF

SEQ ID NO: 833810 - protein, 117 aa, Homo sapiens
GSQLQAGEEGGPYSSFLSMGPSTAACSFACSSSKRSYSLVRPSDPASPSSTSVCALLLPPFPSTAHSSSSRPLSTLSKHITGDLIATRSECVCCHPAWPGQAWHSLGLPRLSVESTS

SEQ ID NO: 833811 - protein, 322 aa, Homo sapiens; identical to SEQ ID NO: 833794

SEQ ID NO: 833812 - protein, 303 aa, Homo sapiens
MTSYELWKGMGEAEGQQTEVLEEENRSLKADLQKLEDELASTKQKLEKAENQVLAMRKQSEGLTKEYDRLLEEHAKLQAAEMARCGRVRLLRRGLHVDCGKLGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833813 - protein, 186 aa, Homo sapiens; identical to SEQ ID NO: 833793

SEQ ID NO: 833814 - protein, 322 aa, Homo sapiens; identical to SEQ ID NO: 833794

SEQ ID NO: 833815 - protein, 253 aa, Homo sapiens
MGAEASSSWCPGTALPEERLSVKRASEISGFLGQGSSGEAALDVLTHVLEGAGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833816 - protein, 322 aa, Homo sapiens; identical to SEQ ID NO: 833794

SEQ ID NO: 833817 - protein, 322 aa, Homo sapiens; identical to SEQ ID NO: 833794

SEQ ID NO: 833818 - protein, 217 aa, Homo sapiens
CVADSVFPFGILGSTPRNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833819 - protein, 186 aa, Homo sapiens; identical to SEQ ID NO: 833793

SEQ ID NO: 833820 - protein, 142 aa, Homo sapiens
HKDDNENHKEGVAILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLDGREQEPEG

SEQ ID NO: 833821 - protein, 322 aa, Homo sapiens; identical to SEQ ID NO: 833794

SEQ ID NO: 833822 - protein, 126 aa, Homo sapiens
CPIAATIPAAIIAFDDEIVSLQYNHRDMELHYLTHFQIPDRISTVRRFTLLLSFLLRRLVTLISQQATLLASNEAFKKQAESASEAAKKYMEENDQLKKGAAVDGGKLDVGNAEVKLDGREQEPEG

SEQ ID NO: 833823 - protein, 109 aa, Homo sapiens
GRSRLELGVEWEQPGGAPASPSCSFSHFSLLFVNNCSLLRRLVTLISQQATLLASNEAFKKQAESASEAAKKYMEENDQLKKGAAVDGGKLDVGNAEVKLDGREQEPEG

SEQ ID NO: 833824 - protein, 322 aa, Homo sapiens; identical to SEQ ID NO: 833794

SEQ ID NO: 833825 - protein, 322 aa, Homo sapiens; identical to SEQ ID NO: 833794

SEQ ID NO: 833826 - protein, 113 aa, Homo sapiens [sequence omitted]

SEQ ID NO: 833827 - protein, 113 aa, Homo sapiens [sequence omitted]

SEQ ID NO: 833828 - protein, 114 aa, Homo sapiens
AGVALQWPRPRGFSPPLVPFSWLLTVNCSSAGSSGGLSKWPPSSPACSWLPPGTCLLLPESPASPSSTSVCALLLPPFPSTAHSSSSRPLSTLSKHITGDLIATLPRLSVESTS

SEQ ID NO: 833829 - protein, 1134 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEVQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSLLAGLHSSPPHAAPLPHAAVPTHIPQSLPGASQLHGKGPAVPRKL

SEQ ID NO: 833830 - protein, 1134 aa, Homo sapiens; identical to SEQ ID NO: 833829

SEQ ID NO: 833831 - protein, 1085 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEVQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSLLAGLHSSPPHAAPLPHAAVPTHIPQSLPGASQLHGKGPAVPRKL

SEQ ID NO: 833832 - protein, 1102 aa, Homo sapiens
PRERVIRTAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEVQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSLLAGLHSSPPHAAPLPHAAVPTHIPQSLPGASQLHGKGPAVPRKL

SEQ ID NO: 833833 - protein, 929 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGGKRKYKALSSTLYTSKLYNHRNYPVVNVYLFIHFETKSHSVAQTGVQWHDLGSLQPPPPKFKRISCLSLPSSWDYRHSPPRLANFVFLVETGFHHVGQAGLELLTSGDPPALASKSAGITGVSHCAWPVDIYMRDELLRTRDTSKVLEAESQLSGACTDAWCSVSFRTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSLLAGLHSSPPHAAPLPHAAVPTHIPQSLPGASQLHGKGPAVPRKL

SEQ ID NO: 833834 - protein, 679 aa, Homo sapiens
MPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSLLAGLHSSPPHAAPLPHAAVPTHIPQSLPGASQLHGKGPAVPRKL

SEQ ID NO: 833835 - protein, 1134 aa, Homo sapiens; identical to SEQ ID NO: 833829

SEQ ID NO: 833836 - protein, 1134 aa, Homo sapiens; identical to SEQ ID NO: 833829

SEQ ID NO: 833837 - protein, 1134 aa, Homo sapiens; identical to SEQ ID NO: 833829

SEQ ID NO: 833838 - protein, 1067 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEVQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSSGSGGCRGFPGAAKVSEHLPGVTVS

SEQ ID NO: 833839 - protein, 216 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTFARVPARF

SEQ ID NO: 833840 - protein, 204 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGESGSIKR

SEQ ID NO: 833841 - protein, 184 aa, Homo sapiens
PRERVIRTAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTFARVPARF

SEQ ID NO: 833842 - protein, 543 aa, Homo sapiens
MAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSLLAGLHSSPPHAAPLPHAAVPTHIPQSLPGASQLHGKGPAVPRKL

SEQ ID NO: 833843 - protein, 1161 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEVQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSLLAGLHSSPPHAAPLPHAAVPTHIPQSLPGNHPTVSVPRAPCAFALSTPRCFAAAKGLGVFALTLLLFWFVL

SEQ ID NO: 833844 - protein, 1039 aa, Homo sapiens
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEVQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSVSICHSSLPCPTHRGLGDEDCLALPRVESEI

SEQ ID NO: 833845 - protein, 425 aa, Homo sapiens
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRFYNFLMADNMKKIILSHRQALFGDHVKKPQSLEDTDLSRLYTATSLMQIDDNVMRKFHGYNSLKEYYEEESCMRYLHRIYVPLMLVNAADDPLVHESLLTIPKSLSEKRENVMFVLPLHGGHLGFFEGSVLFPEPLTWMDKLVVEYANAICQWERNKLQCSDTEQVEADLE

SEQ ID NO: 833846 - protein, 255 aa, Homo sapiens
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALSLLLLVLKTSVLFKK

SEQ ID NO: 833847 - protein, 142 aa, Homo sapiens
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIAKQFKSWI

SEQ ID NO: 833848 - protein, 425 aa, Homo sapiens; identical to SEQ ID NO: 833845

SEQ ID NO: 833849 - protein, 425 aa, Homo sapiens; identical to SEQ ID NO: 833845

SEQ ID NO: 833850 - protein, 852 aa, Homo sapiens
WRYIHTGTAMPCLRIPVLKKLSLTVTQRVTSSPATHGPLKGEEGVSPTVGPVVAPWVLESFLRSFQGQTLGLGSRLYSSDSQTQQDGCDRETLGGDPGAHHELRALAVAPVEGVEAVGEGGRRGQATYGYHLGSGKSSWEDQGRAAGSTQGRKMRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 833851 - protein, 380 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 833852 - protein, 399 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKVQSLALGKGSAQATETLRNLPLPRADGLPELVIVPAQNFLAAHQLLKCSRNSKACVPGGLTL

SEQ ID NO: 833853 - protein, 349 aa, Homo sapiens
MPANSRDTQGPQNKDKASRTPHRARAHRQVKLGGPRPGSREHPRQENEVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 833854 - protein, 380 aa, Homo sapiens; identical to SEQ ID NO: 833851

SEQ ID NO: 833855 - protein, 399 aa, Homo sapiens; identical to SEQ ID NO: 833852

SEQ ID NO: 833856 - protein, 399 aa, Homo sapiens; identical to SEQ ID NO: 833852

SEQ ID NO: 833857 - protein, 252 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKVSLQ

SEQ ID NO: 833858 - protein, 728 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 833859 - protein, 730 aa, Homo sapiens
SGTGTQTSSPNTGKSSWEDQGRAAGSTQGRKMRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 833860 - protein, 387 aa, Homo sapiens
MRPTFMSFRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 833861 - protein, 380 aa, Homo sapiens; identical to SEQ ID NO: 833851

SEQ ID NO: 833862 - protein, 399 aa, Homo sapiens; identical to SEQ ID NO: 833852

SEQ ID NO: 833863 - protein, 109 aa, Homo sapiens
MICAGEKEGGLRGWHTTGALPAREWCRASKGAQRPPNLVGWQCGGAGDWRKAVGGGIPQEKMHRRKDIYRMLIIPFPSSVFPLRKRPWPGTVVHACNPSTLGGRGGWIT

SEQ ID NO: 833864 - protein, 120 aa, Homo sapiens
MIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 833865 - protein, 586 aa, Homo sapiens
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 833866 - protein, 586 aa, Homo sapiens; identical to SEQ ID NO: 833865

SEQ ID NO: 833867 - protein, 538 aa, Homo sapiens
MVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 833868 - protein, 564 aa, Homo sapiens
MLGGTDCRTFLTSHINLKKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 833869 - protein, 494 aa, Homo sapiens
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLVR

SEQ ID NO: 833870 - protein, 166 aa, Homo sapiens
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGEAEKVDQSLPECGMLFTV

SEQ ID NO: 833871 - protein, 136 aa, Homo sapiens
MLGGTDCRTFLTSHINLKKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGKKYQIPVVCL

SEQ ID NO: 833872 - protein, 166 aa, Homo sapiens; identical to SEQ ID NO: 833870

SEQ ID NO: 833873 - protein, 564 aa, Homo sapiens; identical to SEQ ID NO: 833868

SEQ ID NO: 833874 - protein, 564 aa, Homo sapiens; identical to SEQ ID NO: 833868

SEQ ID NO: 833875 - protein, 464 aa, Homo sapiens
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETYVSI

SEQ ID NO: 833876 - protein, 278 aa, Homo sapiens
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVAAEKLPSFGAWAELNWGKASSLSFSDHQLSSYHRTLLPFQSRRKTEKTVEK

SEQ ID NO: 833877 - protein, 111 aa, Homo sapiens
KFTQLIFLKSCFILNVYLVFLKMIFYSFIFFLCLGISVLAECLDCPELKATADDFIHQHFTEVYKTDEFLQLDVKRVTHLLNQDTLTVRAEDQVTKLPSHIFLNKNVFIGF

SEQ ID NO: 833878 - protein, 268 aa, Homo sapiens
FSLPSFFQKKMQSRVTFDTMDFIAEEGHFPPKAIQIMQKKPSWRTEDEIQAVCNILQVLDSYRNYAEPLQLLLAKVMRFERFGRRRVIIKKGQKGNSFYFIYLGTVAITKDEDGSSAFLDPHPKLLHKGSCFGEMDVLHASVRRSTIVCMEETEFLVVDREDFFANKLDQEVQKDAQYRFEFFRKMELFASWSDEKLWQLVAMAKIERFSYGQLISKDFGESPFIMFISKGSCEVLRLLDLGASPSYRRWIWQHLELIDGRPLKTHLS

SEQ ID NO: 833879 - protein, 923 aa, Homo sapiens
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 833880 - protein, 923 aa, Homo sapiens; identical to SEQ ID NO: 833879

SEQ ID NO: 833881 - protein, 957 aa, Homo sapiens
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPKKPFSNAVCRHSLLFGQNITSEISNCEYLPPVLRENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 833882 - protein, 859 aa, Homo sapiens
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 833883 - protein, 923 aa, Homo sapiens; identical to SEQ ID NO: 833879

SEQ ID NO: 833884 - protein, 206 aa, Homo sapiens
ILETILLFKKLKGGDAQCLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 833885 - protein, 837 aa, Homo sapiens
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDFCKGVESEDFRLCRPYSLCCKCSALLL

SEQ ID NO: 833886 - protein, 855 aa, Homo sapiens
MKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 833887 - protein, 565 aa, Homo sapiens
MHRTSRVSPFPEPSARNTVDVFVQKGSGWGAAPSPFLSQLSFPKDTDMYFFSIVRFPSMECFAQLYSTLKEGNPPWEVTEAVLFIMAAIAKSVDPENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 833888 - protein, 923 aa, Homo sapiens; identical to SEQ ID NO: 833879

SEQ ID NO: 833889 - protein, 909 aa, Homo sapiens
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTRNVFFN

SEQ ID NO: 833890 - protein, 544 aa, Homo sapiens
ATVPCSEAPGSSVKPVLCLHSAARAGKWSLGSGAEQQRLSPGPPVPSLTCLPSARMATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKKRKSSSSVQLMESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 833891 - protein, 533 aa, Homo sapiens
ATVPCSEAPGSSVKPVLCLHSAARAGKWSLGSGAEQQRLSPGPPVPSLTCLPSARMATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 833892 - protein, 515 aa, Homo sapiens
ATVPCSEAPGSSVKPVLCLHSAARAGKWSLGSGAEQQRLSPGPPVPSLTCLPSARMATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKAPVSAPYLELTSWSVTIAHEVGAAVNLILQLRKQRTERPVWSRNSKPVHTTILNPHIHLMGDESACIAYIRITQYLDAGGIPRTAQSEETRVWHRRDGKWQIVHFHRSGAPSVLPH

SEQ ID NO: 833893 - protein, 203 aa, Homo sapiens
ASSAPCSLPSGCVWMLLVLALWALVPCLALLTLYFFSSTGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 833894 - protein, 124 aa, Homo sapiens
MRSRPSPSSLWLLSPRKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 833895 - protein, 104 aa, Homo sapiens
LDEESSLATLPRLVSELLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 833896 - protein, 467 aa, Homo sapiens
ATVPCSEAPGSSVKPVLCLHSAARAGKWSLGSGAEQQRLSPGPPVPSLTCLPSARMATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENREQFLLSVVPV

SEQ ID NO: 833897 - protein, 415 aa, Homo sapiens
ATVPCSEAPGSSVKPVLCLHSAARAGKWSLGSGAEQQRLSPGPPVPSLTCLPSARMATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEE

SEQ ID NO: 833898 - protein, 533 aa, Homo sapiens; identical to SEQ ID NO: 833891

SEQ ID NO: 833899 - protein, 533 aa, Homo sapiens; identical to SEQ ID NO: 833891

SEQ ID NO: 833900 - protein, 533 aa, Homo sapiens; identical to SEQ ID NO: 833891

SEQ ID NO: 833901 - protein, 533 aa, Homo sapiens; identical to SEQ ID NO: 833891

SEQ ID NO: 833902 - protein, 542 aa, Homo sapiens
ATVPCSEAPGSSVKPVLCLHSAARAGKWSLGSGAEQQRLSPGPPVPSLTCLPSARMATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPHRESVGTELL

SEQ ID NO: 833903 - protein, 465 aa, Homo sapiens
ATVPCSEAPGSSVKPVLCLHSAARAGKWSLGSGAEQQRLSPGPPVPSLTCLPSARMATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSYLR

SEQ ID NO: 833904 - protein, 127 aa, Homo sapiens
MPKNKGKGGKNRRRGKNENESEKRELVFKEDGQEYAQVIKMLGNGRLEALCFDGVKRLCHIRGKLRKKDNKADVILKYNADEARSLKAYGELPEHAKINETDTFGPGDDDEIQFDDIGDDDEDIDDI

SEQ ID NO: 833905 - protein, 144 aa, Homo sapiens
MPKNKGKGGKNRRRGKNENESEKRELVFKEDGQEYAQVIKMLGNGRLEALCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 833906 - protein, 144 aa, Homo sapiens; identical to SEQ ID NO: 833905

SEQ ID NO: 833907 - protein, 1118 aa, Homo sapiens
RAEGSLKIFISAPYWLINKTGLPLIFRQDNAKTDAAGQFEEHELARSLSPLLFCYADKEQPNLCTMRIGRGIHPEGMPGWCQGFSLDGGSGVRALKVIQQGNRPGLIYNIGIDVKKGRGRYIDTCMVIFAPRYLLDNKSSHKLAFAQREFARGQGTANPEGYISTLPGSSVVFHWPRNDYDQLLCVRLMDVPNCIWSGGFEVNKNNSFHINMRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVILKKKEPGKRSQLWRMTGTGMLAHEGSSVPHNPNKPSAARSTEGSAILDIAGLAAVTDNRYEPLMLRKPDRRRSTTQTWSFREGKLTCGLHGLVVQAKGGLSGLFDGAEVVLGPDTSMELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 833908 - protein, 189 aa, Homo sapiens
MYLLVCFSKYHLLQTGVHDIFRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 833909 - protein, 516 aa, Homo sapiens
ARVTALINIYKHLMITAQRFTVQIEEKLLLKLLSFFGYDQAESDLEFKLEEYLGSRARSCLFNAVFSTLGWNASVYLYSDSHLGACLPEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 833910 - protein, 916 aa, Homo sapiens
LGASREAPPPRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVILKKKEPGKRSQLWRMTGTGMLAHEGSSVPHNPNKPSAARSTEGSAILDIAGLAAVTDNRYEPLMLRKPDRRRSTTQTWSFREGKLTCGLHGLVVQAKGGLSGLFDGAEVVLGPDTSMELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 833911 - protein, 916 aa, Homo sapiens; identical to SEQ ID NO: 833910

SEQ ID NO: 833912 - protein, 864 aa, Homo sapiens
LGASREAPPPRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVILKKKEPGKRSQLWRMTGTGMLAHEGSSVPHNPNKPSAARSTEGSAILDIAGLAAVTDNRYEPLMLRKPDRRRSTTQTWSFREGKLTCGLHGLVVQAKGGLSGLFDGAEVVLGPDTSMELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTNKRLGNPLERPQ

SEQ ID NO: 833913 - protein, 916 aa, Homo sapiens; identical to SEQ ID NO: 833910
